United States Patent 9,958,448 (APTAMERS AND USES THEREOF) - sequence listing, part 17

SEQ ID NO: 226326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttgttagatggttcccgagaatggttagt

SEQ ID NO: 226327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtttatttacccgtcttcatagactcattt

SEQ ID NO: 226328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtttgggggctatacaaaggcttacggggc

SEQ ID NO: 226329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttttgtggtttagttttgtcggcccgcgt

SEQ ID NO: 226330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttttttacatgtggtagcttgtattacgc

SEQ ID NO: 226331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataaaaactctggagctgatttgcgctctcg

SEQ ID NO: 226332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataaagccagcaggttgttcatctcagctga

SEQ ID NO: 226333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataaaggtgtatggttcagtaaaatgagtag

SEQ ID NO: 226334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataaatttcttgattagtcctctcctacaca

SEQ ID NO: 226335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataacgcaaatttaacgtctactgacggtca

SEQ ID NO: 226336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataacgtgcactggattagacgagagcaaag

SEQ ID NO: 226337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataagacgtcggctcacttaactgttacctc

SEQ ID NO: 226338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataagatatcgatttagtacggttgtttctg

SEQ ID NO: 226339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataagcactgcaggggtcttcgataattaga

SEQ ID NO: 226340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataaggagaaggttgttggcttcgtcgccgg

SEQ ID NO: 226341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataagggaggttttcgaggtcgcgacgagtt

SEQ ID NO: 226342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataaggtgggaccggttgatgtgaaatgctg

SEQ ID NO: 226343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataaggtgttttgtaacctctggcacccagt

SEQ ID NO: 226344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataagtagcttgttgcatatgtaagcaagta

SEQ ID NO: 226345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataagtgaagagctgagaggttctctcctgc

SEQ ID NO: 226346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataatatttggtattcgtgtagaatataatt

SEQ ID NO: 226347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataatcggcggcagtccattttaaggcggca

SEQ ID NO: 226348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataatgggaatgttggctcaccctcagcgga

SEQ ID NO: 226349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataatgggtaggattggtttgttaaagcgac

SEQ ID NO: 226350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataattacgagaaatctgcgctcgatcggta

SEQ ID NO: 226351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacaagtattacaaactgtactggttttcg

SEQ ID NO: 226352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacaatgcacggttttctcttcgtcgatag

SEQ ID NO: 226353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacaattatacgctccgtactctgcgccta

SEQ ID NO: 226354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacacaattcgaggcatatttttggatagt

SEQ ID NO: 226355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacatgagaccgcgctttcgctcttgggaa

SEQ ID NO: 226356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacatgatttagtaagggggaattcgacgg

SEQ ID NO: 226357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacattggacgcctttacgcgcgctgatcg

SEQ ID NO: 226358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataccagcctgttcttaaattacagcatcat

SEQ ID NO: 226359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataccatccgactccatactcggcttagaat

SEQ ID NO: 226360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataccccattgactgaaagtgtccagcgggc

SEQ ID NO: 226361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacctttacgattcagacaaattgtgcttc

SEQ ID NO: 226362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacgccaggttctttgggcacgggtcatta

SEQ ID NO: 226363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacgctcctttatgcacgggcggtgtcttt

SEQ ID NO: 226364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacggaacaaacgctatatacgtggattgt

SEQ ID NO: 226365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacggttgggacggggatcacttcgtggtg

SEQ ID NO: 226366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacgtacttacctggtatatgtgtttagtg

SEQ ID NO: 226367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacgttgattgccttggcttgctattttcc

SEQ ID NO: 226368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatactacccggtcctatgtgaaagtaactcg

SEQ ID NO: 226369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatactacttcagctattaggtttttgtccat

SEQ ID NO: 226370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatactagccctcatttaagagacaccgcgcc

SEQ ID NO: 226371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatactatgccttccgacggtgaggtttgtcc

SEQ ID NO: 226372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatactattgaacatcatgtcagcctcggagt

SEQ ID NO: 226373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatactcattgggggttcttccatcttaaata

SEQ ID NO: 226374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacttgccactcagtttatctaaagtcact

SEQ ID NO: 226375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacttggcccaacttccttagtagcgcact

SEQ ID NO: 226376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatactttactggtcaccacaatatccgttgg

SEQ ID NO: 226377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagaaaatggcactttgaatcgcgatcatc

SEQ ID NO: 226378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagaatgttcgagcgcgttcgagatcttta

SEQ ID NO: 226379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagatttctttggcgttggtgcggggtgta

SEQ ID NO: 226380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagcccatgaagggtttatctttctcatgg

SEQ ID NO: 226381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataggaccatcacctttttactgtcaagttt

SEQ ID NO: 226382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataggcgagcctccggagatttgttatgcgg

SEQ ID NO: 226383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataggttccttgttcgggctttatgcggttg

SEQ ID NO: 226384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataggtttccgaggtatgtacggggtgtggg

SEQ ID NO: 226385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagtacactgaacagttcaacatgcacacc

SEQ ID NO: 226386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagtgcaaggtcctgtaggtccatatcttg

SEQ ID NO: 226387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagtgctattacgttcgctgcgagaatgtg

SEQ ID NO: 226388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagttccgaggttaggaggttaggcttggt

SEQ ID NO: 226389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatacgttccctcttgagggctcaatcttc

SEQ ID NO: 226390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatcactcagcctgtccacgctttcgacga

SEQ ID NO: 226391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatccagctgtttgttgcgtgagagtcaaa

SEQ ID NO: 226392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatcctacttcttcgtgtgcttagttgctc

SEQ ID NO: 226393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatcgaaatcatccacgtgtgctcgtgacc

SEQ ID NO: 226394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatcgttcgagggaggtggccacaagagat

SEQ ID NO: 226395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatcttgcaaagttcacatgggcctaagta

SEQ ID NO: 226396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatgaaatcattgtaaagtgttgaacaggg

SEQ ID NO: 226397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatgaatttgcaaggctctctggtgattct

SEQ ID NO: 226398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatgacaacttgtctttaaccggggtaaac

SEQ ID NO: 226399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatgattggggggctgtggcgatatgcttg

SEQ ID NO: 226400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatgcctgtcagggtaactgtcataaatat

SEQ ID NO: 226401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatggaagtgattaagtaacgttacgaggt

SEQ ID NO: 226402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatgtctttcaacgtggagtgggtggtgtt

SEQ ID NO: 226403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatattctcgccatgcttaacaggtatctgct

SEQ ID NO: 226404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatattgatgtcaaaccaagttcgttgcttat

SEQ ID NO: 226405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatttgacacgtgtgctttagaactccgag

SEQ ID NO: 226406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatttgttgtagcagcatgtcctggtccat

SEQ ID NO: 226407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatattttgaaagtgtgcaactgctacaacgt

SEQ ID NO: 226408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaaaaaatgtctttggttcttggcaatcc

SEQ ID NO: 226409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaaatttattttctaaggggaagggattc

SEQ ID NO: 226410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaaccgatctctcgatatgcggatcttat

SEQ ID NO: 226411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaacgccacgttcttaatcgtaacacgtc

SEQ ID NO: 226412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaactgcagctaggggtagggggtagtgc

SEQ ID NO: 226413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaaggaataacggcctttctgacattttc

SEQ ID NO: 226414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaatatgctctgcccgcggactataccaa

SEQ ID NO: 226415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaatctgtaggcaagcggcggtggtgttt

SEQ ID NO: 226416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaattgaaaccaaaagatgataaactgcc

SEQ ID NO: 226417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcactcatcagtttatcttatttagcttta

SEQ ID NO: 226418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcactcggggccgatcaccgcgtcgaggta

SEQ ID NO: 226419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcagaacgttacaaaaagccaacattcggg

SEQ ID NO: 226420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcagatactcttctaaaggcttgctagtac

SEQ ID NO: 226421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcagcaatacgaaaacaatgtaagtcttgt

SEQ ID NO: 226422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaggcctttacaacttcgatccaatacat

SEQ ID NO: 226423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaggtctacggggccggtcctactcactc

SEQ ID NO: 226424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaggtctcgttgagcttagccgcgatccc

SEQ ID NO: 226425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcagtggggatctatgcaaactgggcgtct

SEQ ID NO: 226426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcatattgttggtttcctgcgtcggggttg

SEQ ID NO: 226427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcatgacggctggacagaattacggttact

SEQ ID NO: 226428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcatgcagtcaaagaattgcctgggctttc

SEQ ID NO: 226429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcatgtgcccagtctttacaatcgtgttcg

SEQ ID NO: 226430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcatgttgtggtattcgactattgggaatg

SEQ ID NO: 226431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcattaagtactctgctgcacttgagacgg

SEQ ID NO: 226432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcattataggttatggcggatgctcgggcc

SEQ ID NO: 226433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccatgctttcgggagctagctgcggagtg

SEQ ID NO: 226434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccattttcacacaatcggtggagaagatc

SEQ ID NO: 226435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcccacgccatattcagtaacattaatctc

SEQ ID NO: 226436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcccattggtaccgggttgggcgatctgta

SEQ ID NO: 226437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcccctcacctgttagagcgcccgttttta

SEQ ID NO: 226438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcccgtgctcattaactacgtttcctaacc

SEQ ID NO: 226439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcccgtgggccccgttcaggacagagctgc

SEQ ID NO: 226440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccgaccaagccgttgtccagctgccccta

SEQ ID NO: 226441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccgcagtctgtccgtcggcgatcacaggc

SEQ ID NO: 226442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccgcattgttaaagacttgattccacctt

SEQ ID NO: 226443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccggctaggttagtggcgagcagaatgga

SEQ ID NO: 226444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccggggtattagagtaggttagtaggtac

SEQ ID NO: 226445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccgtctatcggattaggagtctccctctt

SEQ ID NO: 226446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccgtgtttgcagactgcttgacagctaat

SEQ ID NO: 226447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcctaacattctttcaatgacatggcgtcc

SEQ ID NO: 226448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcctacatccacttgccgaccggtcatttg

SEQ ID NO: 226449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcctacgggggttttgtggcgctggactat

SEQ ID NO: 226450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcctctcggcgctgagcatgagcacctgtc

SEQ ID NO: 226451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcctgcttcacttgatgtagcgttctcctt

SEQ ID NO: 226452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcctggccggcgcacctgttcacataggct

SEQ ID NO: 226453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcctggtacatggtgacgtaattgccgttg

SEQ ID NO: 226454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgaaagacacgtattgttttctttgttta

SEQ ID NO: 226455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgacgcagaggtatgacaggttagcgtgt

SEQ ID NO: 226456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgagcatgggtaggcccggttcaatgttt

SEQ ID NO: 226457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgagttttgtgtccgtgcatagttcacag

SEQ ID NO: 226458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgattttcctgactcagtacgaaaccagc

SEQ ID NO: 226459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgcaacctttctgtttggtacgtcctctt

SEQ ID NO: 226460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgcaatcccaacgtcgggggttgtcgggt

SEQ ID NO: 226461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgccagcacagcgtctgcaccggggatgg

SEQ ID NO: 226462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgctattaaagtctgtacaagcatcgaca

SEQ ID NO: 226463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgctggattctcggtgcaatgttatggtc

SEQ ID NO: 226464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgcttctcgtgggaacctgctttgttatg

SEQ ID NO: 226465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgctttgcattgaccttggcaggaacctt

SEQ ID NO: 226466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcggaatggtagggtccaccctcgacggga

SEQ ID NO: 226467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgggaaggttcgcgagtgtggtgacagtg

SEQ ID NO: 226468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgggactaactcctcgcgattctaatgac

SEQ ID NO: 226469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgggtacaaattttgtataacttcgggcc

SEQ ID NO: 226470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgggtccgcttcatctcgtaaaggcccga

SEQ ID NO: 226471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcggtactcaagctgtccgcctggataggg

SEQ ID NO: 226472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcggtgaaaacgaaagaatatctatattct

SEQ ID NO: 226473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcggttggatatgcctggaaataacattaa

SEQ ID NO: 226474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcggttttagactggcgctcttcccagttg

SEQ ID NO: 226475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctaaccgtatccgttagcataatctttga

SEQ ID NO: 226476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctaattctaaaatagttgcaatgtaccac

SEQ ID NO: 226477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctacagaatgccattgcaacttaactagg

SEQ ID NO: 226478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctactttggacggtttagtattctttcgc

SEQ ID NO: 226479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctagattgcatggtccatattattcttta

SEQ ID NO: 226480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctattacgcctcactcagcaggcatgccc

SEQ ID NO: 226481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctcgattagcaccctctgctcgcgacgta

SEQ ID NO: 226482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctcgcgacttacaagcgtttcgcgatcct

SEQ ID NO: 226483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctcgtgttatctgaacgtggaatcatcga

SEQ ID NO: 226484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctgacccgcgactttgacgagtggtggct

SEQ ID NO: 226485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctgaggtacgacggatctacgcagcttgc

SEQ ID NO: 226486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctggacctccttgctttagtttggttacg

SEQ ID NO: 226487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctggtattctcatccgggcagacaacccg

SEQ ID NO: 226488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcttacaccctgctgctagttcacgtcctg

SEQ ID NO: 226489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcttactgtgggtgcggagcggcatgtgct

SEQ ID NO: 226490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcttgcagattttacacaatctcccgtgtc

SEQ ID NO: 226491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcttggggtattttccatggcgactcgcgc

SEQ ID NO: 226492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctttacacattttttacggtgatttgacg

SEQ ID NO: 226493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctttcaatatgacttattattaaattgct

SEQ ID NO: 226494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgaaatacgtttgatggagcctaaattaac

SEQ ID NO: 226495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgaagagaacttcacaatttcggactgcgc

SEQ ID NO: 226496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgaccatccgcagtctatctagtgcaggac

SEQ ID NO: 226497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgacctatttccgcggtttgcgaacaaggc

SEQ ID NO: 226498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgacgacaatgtatgggatttaggtgcctc

SEQ ID NO: 226499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgacgcacttggttgcaaagtaatagggcc

SEQ ID NO: 226500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgactctccgtcaattatgcattcaacggt

SEQ ID NO: 226501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgactgcggggcggttagtgtgcagggctg

SEQ ID NO: 226502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgagacactatccctcgaggggtgtctgat

SEQ ID NO: 226503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgagagcagcagcgaacgcatgttatagct

SEQ ID NO: 226504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgatatggtacatattgcttgcgtacgttt

SEQ ID NO: 226505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgatccgcacggggtttggtttgcttctcc

SEQ ID NO: 226506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgatgcttcacacagtttagctcgtacggt

SEQ ID NO: 226507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgattaagggtgggtgagatcactcgtacc

SEQ ID NO: 226508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgattctgattttacctcactctgaccgga

SEQ ID NO: 226509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgattgcccaagttgccacgataactccca

SEQ ID NO: 226510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcaacagcaggtcctgtttgcccacacca

SEQ ID NO: 226511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcacaatgaagctcaggccattcacggtg

SEQ ID NO: 226512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcaggtttagcgttcccccttgcaattgt

SEQ ID NO: 226513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcagtttaactcttcctggactctcttgc

SEQ ID NO: 226514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcatatcgggttgacgggtactacacagc

SEQ ID NO: 226515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcatatcttgtttattcgtgtgcaacgcg

SEQ ID NO: 226516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgccatatgcaaaacttataaaagattcct

SEQ ID NO: 226517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcccgcttcatttgcgtcccatgcttcac

SEQ ID NO: 226518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcccggcgctcgggagggtgttttattcg

SEQ ID NO: 226519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcccgtggttagggtgggtccttcgtttc

SEQ ID NO: 226520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgccctgctttaattcccgggtttgataag

SEQ ID NO: 226521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgccgtgacgacaatgtcgatttttagagg

SEQ ID NO: 226522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgccttctgaatttgacgtcggttgccgcg

SEQ ID NO: 226523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcgcacctttttgggtattgatatactgt

SEQ ID NO: 226524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcggacttgggcaggcacgaggaagttgt

SEQ ID NO: 226525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcggagtatagtttttctgttctttaatt

SEQ ID NO: 226526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcggcacatgggggaaaatcgatcgcgag

SEQ ID NO: 226527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcgggccttgcctccctttcccactttca

SEQ ID NO: 226528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcggtgactatatcaatttggtgtacgtg

SEQ ID NO: 226529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgctaagtctttgcgactgttacacatcta

SEQ ID NO: 226530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgctattagccgcgtcatgccccggtcaag

SEQ ID NO: 226531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgctcctggtatttgcatcctccttgctgt

SEQ ID NO: 226532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgctcgtgggccaccaaagtttcaataact

SEQ ID NO: 226533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgctggatccaattaccacctccgaccttg

SEQ ID NO: 226534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcttggacactataagccgcggcgcgctg

SEQ ID NO: 226535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggaaaattctcagtcgcccttttagtagg

SEQ ID NO: 226536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggaagttaacggtttctctccacgcgcgc

SEQ ID NO: 226537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggagagggtcgacgtctgtcagtcagaag

SEQ ID NO: 226538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggagctgatcgttttgtcgtgggccccct

SEQ ID NO: 226539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggagtgtacgacccggctctgtagtaacc

SEQ ID NO: 226540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggattgttgaatgaacttattctgtaatc

SEQ ID NO: 226541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggatttatgttgggctctccactgttcta

SEQ ID NO: 226542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggcccccgacagaaacattatttcaatat

SEQ ID NO: 226543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggcccgcttctagtaccttgctgtacgag

SEQ ID NO: 226544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggccctcctccatccgctaccacggaaca

SEQ ID NO: 226545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggcttctggaaacgaagaacgggaaggcg

SEQ ID NO: 226546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggcttttgatcggtcccgagaatatttag

SEQ ID NO: 226547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggaatcattaactcgggctaaggtttgg

SEQ ID NO: 226548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggacacttcactgcctttgcgtgtcatg

SEQ ID NO: 226549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggataggtaagattgtgctaagggtgtg

SEQ ID NO: 226550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggcagcagaggcaataaagcgacccaca

SEQ ID NO: 226551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggcgctacgttctgtgcgtaaattactc

SEQ ID NO: 226552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggggaattccttcgagtcgttattagtaa

SEQ ID NO: 226553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggggaaccttgtctgtgtggccgcgatt

SEQ ID NO: 226554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggtacgccatttcgcgtcagacgcttcc

SEQ ID NO: 226555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggtgggaagaagggatatctctgcgtag

SEQ ID NO: 226556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggtatagggcgagcgtgatgttgatcata

SEQ ID NO: 226557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggtcggatatgatagtcatacctaacttc

SEQ ID NO: 226558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggtctagtatggcacctaagtgggggtat

SEQ ID NO: 226559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggtgatttatggctgtcattcctatcggc

SEQ ID NO: 226560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggtgcgattgccgaacaataccatctccg

SEQ ID NO: 226561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggttatgcacgttggctttgatatagggc

SEQ ID NO: 226562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggttgatccattttcccaagttcgttccc

SEQ ID NO: 226563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggttttttcatcttctcttcacactgtgc

SEQ ID NO: 226564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtaagtgcgcctagcacccagagcaccct

SEQ ID NO: 226565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtaattcccgcaccagatcggggatgtgc

SEQ ID NO: 226566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtagccggatctaactgctagcctgcacg

SEQ ID NO: 226567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtagctctcgggcaggggtggggcgggta

SEQ ID NO: 226568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtaggtggtaggcaggtttatttcacgcc

SEQ ID NO: 226569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtattatgcatttgggtaacttgccatcc

SEQ ID NO: 226570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtcccttaaagtgtaggtatatatcgagc

SEQ ID NO: 226571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtccgagtagacttcgtgcggtggtaaaa

SEQ ID NO: 226572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtccttccgctgccgccgttggttgaagc

SEQ ID NO: 226573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtcgcacagtaagagccgcgataggttca

SEQ ID NO: 226574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtctccttcctccggaagcggccttttcc

SEQ ID NO: 226575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtcttagattgactacttacccttgctgg

SEQ ID NO: 226576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtgaataacttcaagtccgaagagactgt

SEQ ID NO: 226577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtgacaactattaacccccggtcacggca

SEQ ID NO: 226578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtgcctggctcaagatataaattaccgga

SEQ ID NO: 226579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtggcggcatcaacaatctaaatgaccgg

SEQ ID NO: 226580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtgggagaaccctatctcttgccctcctg

SEQ ID NO: 226581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtgggccacaatatgctgctgggaatgtt

SEQ ID NO: 226582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtggggttacaatttgggcccggtaaata

SEQ ID NO: 226583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtggtttgcgctttcgagttgtcactggg

SEQ ID NO: 226584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtgtacacgtttatggtttttatttgatg

SEQ ID NO: 226585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtgtaggcgggatttatttgctagatgag

SEQ ID NO: 226586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtgtatgattttgggtctcctctgcctgg

SEQ ID NO: 226587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgttaagttcggtttgcaacaatagttctc

SEQ ID NO: 226588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgttagaaaatagttttgcgcgtttggttc

SEQ ID NO: 226589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgttatgactgttttgccaaaggttttctt

SEQ ID NO: 226590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgttgatgcaaagctttccggtctagttta

SEQ ID NO: 226591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgttgcggtgtaataacccagcattggaat

SEQ ID NO: 226592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgttgtccgcacatcatggtacccggagat

SEQ ID NO: 226593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtttccggagtatcgtaagtcgtacgtag

SEQ ID NO: 226594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgttttttcgggttggatttaagcgttggg

SEQ ID NO: 226595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattaaccttctcggttccactgctttaccgc

SEQ ID NO: 226596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattaactccgcaaccaacgcccattcgattt

SEQ ID NO: 226597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattaagcggcgagctcaccatgtgcttttat

SEQ ID NO: 226598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattaagcttgggtgccagtacataggaacgg

SEQ ID NO: 226599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattaatgggagtatgaatctgtttggacaac

SEQ ID NO: 226600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattacagaaagtaaggtgactgatggctaga

SEQ ID NO: 226601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattacccaccattttttctgcagtcaggtcc

SEQ ID NO: 226602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattaggcttatatactggaagtagctgatcg

SEQ ID NO: 226603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattaggggctctaatttcctatgccctaacg

SEQ ID NO: 226604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattagggtgcattgtcaacatcctgttctac

SEQ ID NO: 226605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattaggtttcaatatatatcctaggtagttg

SEQ ID NO: 226606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattatattgtgtcacattggaattttggtgt

SEQ ID NO: 226607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattatcacaggctttcaactgttccgccgcg

SEQ ID NO: 226608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattatcagcgctactcggtaggaccatgcac

SEQ ID NO: 226609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattattcgtgttaccccacggtcgccgagaa

SEQ ID NO: 226610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcaatctatcggcggcaatccaaactatt

SEQ ID NO: 226611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcacagaccaactctgaatttctcaggta

SEQ ID NO: 226612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcacgcctaatcagaccgccttttcatta

SEQ ID NO: 226613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcacggcagcatcctacttatgagcagaa

SEQ ID NO: 226614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcattggctgtcgagatgggatatctggc

SEQ ID NO: 226615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattccattcattgattttggcccggcgactg

SEQ ID NO: 226616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattccattgtggcggaactattcgtgacgta

SEQ ID NO: 226617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcccgagggagatccgtaagtaaacccat

SEQ ID NO: 226618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattccgcaataattcctgcctactagacttt

SEQ ID NO: 226619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattccgcgtttctttctcgctttgacggtta

SEQ ID NO: 226620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcctaggattgtcttgtatgcggtggcct

SEQ ID NO: 226621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcctaggtcggggatcgggcccttcagtt

SEQ ID NO: 226622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcctcactacgcgtctgaatgatgttact

SEQ ID NO: 226623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcgacattacgaccattggtgcctaagtc

SEQ ID NO: 226624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcgactccccagttagatcgtcaccttga

SEQ ID NO: 226625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcgagaagcaccggcacgcgccctaaacg

SEQ ID NO: 226626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcgatcgtactgtcgaagatgtggctgtc

SEQ ID NO: 226627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcgctgaatcctagctgccgcatcttacc

SEQ ID NO: 226628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcgctttctcgagtgatactagtactctg

SEQ ID NO: 226629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcggccatatggtagccgttcattgggat

SEQ ID NO: 226630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcgggttaaagcaaccgacttcacgcagt

SEQ ID NO: 226631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcggtgcacgttgctcgcgtgtttttgcc

SEQ ID NO: 226632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcgtgtccgcactggctttatatttaccc

SEQ ID NO: 226633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcgttgcgatgctggacacatggatctga

SEQ ID NO: 226634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattctatcaatacacggcgcgcattacttgt

SEQ ID NO: 226635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattctcggatttgtgatctccggacccttaa

SEQ ID NO: 226636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattctggaaacttgaattgagttgaagttat

SEQ ID NO: 226637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcttaaggactccacttgcaattactacc

SEQ ID NO: 226638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcttaggacgtgttgcacaaaaggtccct

SEQ ID NO: 226639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcttgctcctagaacccagtatcaatccg

SEQ ID NO: 226640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgaaggcactacgttcttaggcttagcta

SEQ ID NO: 226641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgacagtctatttcataacaccactacgt

SEQ ID NO: 226642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgaccctcagtatccatttagctactgac

SEQ ID NO: 226643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgacgtggataatggtatgcggcctattt

SEQ ID NO: 226644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgactatactcgcagcttcgcttggtcat

SEQ ID NO: 226645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgagactcccctcgctattgggccccggt

SEQ ID NO: 226646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgagttatatggtcgagagataatccgaa

SEQ ID NO: 226647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgcaaagctaaggatacgcttgacaggtg

SEQ ID NO: 226648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgcaagaaagagcaaccccagaagccatc

SEQ ID NO: 226649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgcatacttaatctcagttttgtgcggcc

SEQ ID NO: 226650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgcccgtatgttgatggttagcccgggac

SEQ ID NO: 226651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgcgcagttcgggatcgtgttctgatcac

SEQ ID NO: 226652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgcggcctgcttcgaaatgttcggcgtga

SEQ ID NO: 226653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgctcaccaattcacgcaaaaggagattc

SEQ ID NO: 226654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgctcgggtccagacgttcgtacctttta

SEQ ID NO: 226655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattggagggattttagggtggcgaaccgcct

SEQ ID NO: 226656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattggagtccggtcttgagctgatatcgtgg

SEQ ID NO: 226657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattggatttcggtgacaaggcgaaatcgtag

SEQ ID NO: 226658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattggctgtctcttacatcacgagctttatt

SEQ ID NO: 226659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattggggaggtgaggattgagagcagtaacg

SEQ ID NO: 226660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattggggcggttttccagttgttattccttt

SEQ ID NO: 226661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattggttctccgccgtgcttgtggcctaact

SEQ ID NO: 226662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgtaatgaatagttatacttttctgttcc

SEQ ID NO: 226663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgtacaacttggtattaccttactggtcg

SEQ ID NO: 226664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgtataaacggggtggtggactggtgatt

SEQ ID NO: 226665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgtctaatggagtttcacgccgtacacaa

SEQ ID NO: 226666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgtctctttggaattctcggtgattcggc

SEQ ID NO: 226667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgtgcgaagcgttaccttactggagtcgt

SEQ ID NO: 226668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgtgttctgggtgtatgtcggagttttgg

SEQ ID NO: 226669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgttccgcggtcacgagctcaccggcctg

SEQ ID NO: 226670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgttggtaagttcggtgctatgatgtctc

SEQ ID NO: 226671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgtttgccccatacgagaaaatgcttacg

SEQ ID NO: 226672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgtttgcctcatagcttctgcgggtactg

SEQ ID NO: 226673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgttttgcaaaggtgctctcaaaatcggt

SEQ ID NO: 226674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgtttttcgtacttaacggcattggtcta

SEQ ID NO: 226675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttaaaccaatcgaacgagaccctacgatg

SEQ ID NO: 226676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttaatgggacatttatgattgctgtcatt

SEQ ID NO: 226677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttaatttgtgttaggggacgagatctttt

SEQ ID NO: 226678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttaccaaggtttggccaacatgaagtagg

SEQ ID NO: 226679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttactaatgttattggctcgatcgggttc

SEQ ID NO: 226680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttacttcgatcggttaagcgttgccgctg

SEQ ID NO: 226681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttacttcgcattgggtctctcgcggatct

SEQ ID NO: 226682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttagactatccgcggcggtggacataagt

SEQ ID NO: 226683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttagtttttaatttaaacttatatagaca

SEQ ID NO: 226684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttatcacggatcatactatttggcaactc

SEQ ID NO: 226685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttatccgacattcaaggccgactatccca

SEQ ID NO: 226686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttatgagtataactttctcatagtctgag

SEQ ID NO: 226687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttatgtttgtacggtcgataactattctc

SEQ ID NO: 226688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttatttgtcgggcaaagcgtagttattgg

SEQ ID NO: 226689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttcaaacgagagcgaaattgtatcagttt

SEQ ID NO: 226690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttccggccggatattcgcaaaacttgaaa

SEQ ID NO: 226691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttccgtccgggtcttaacaggcaccggta

SEQ ID NO: 226692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttcggtataatacttggcctcagactgca

SEQ ID NO: 226693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttcggtattttctcagctaggatactatt

SEQ ID NO: 226694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttcgtgtgatgtgtagttgcgatccacct

SEQ ID NO: 226695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttcttacaatagaagttcgtaccctgcgt

SEQ ID NO: 226696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttgacctcattagaaatgatgtgctggat

SEQ ID NO: 226697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttgagccgtaccaataatcgaatgacgat

SEQ ID NO: 226698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttgatacttcaggttcgctcgcagtgggg

SEQ ID NO: 226699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttgctgttcctgggagtaaatggcgaaac

SEQ ID NO: 226700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttggcaagggggtagctgtagttgtttca

SEQ ID NO: 226701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttgggtcactccacacgccactctctcga

SEQ ID NO: 226702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttgtcatgagacttcgggaagtagttcgc

SEQ ID NO: 226703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttgtgccacacagtattcctcgcccgtag

SEQ ID NO: 226704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttgttcgccttgagctttttacttgcgac

SEQ ID NO: 226705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattttattacgtccgatttgcgcggatttgc

SEQ ID NO: 226706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattttattagttatgcatacagtttgaacag

SEQ ID NO: 226707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattttccccactgggtttatttcagctggtt

SEQ ID NO: 226708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattttgaggctgtccgatacggtagctctgg

SEQ ID NO: 226709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattttggtttctgcctccccgataccgtgcc

SEQ ID NO: 226710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattttgtgctttcatgcgggcggtttaagcc

SEQ ID NO: 226711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttttcggctaatgccgatccgtctgtggg

SEQ ID NO: 226712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaaagatttagggtacaagggggtcagggc

SEQ ID NO: 226713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaaatgtcgcgatttggttaataatccatg

SEQ ID NO: 226714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaacacaacaaaggcccatttgttttattg

SEQ ID NO: 226715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaacgggggccgacactgtttacttcgcta

SEQ ID NO: 226716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaacgtaatctcttcagcgattgcctgagc

SEQ ID NO: 226717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaagcccagccccgccgatctttcttttgc

SEQ ID NO: 226718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaagctacggtagaagagtattaccgatgt

SEQ ID NO: 226719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaagcttaataccattcgtgatgagaaatc

SEQ ID NO: 226720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaaggtctcccggttggggcgacagctact

SEQ ID NO: 226721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaagtctgcctctttttcgcccaacgttga

SEQ ID NO: 226722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaatatgaaagttgtaggaactgagaatgg

SEQ ID NO: 226723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaatccgtgtgcgccgggccgttgatcctt

SEQ ID NO: 226724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaattctttccgcgagcaattccatgagtc

SEQ ID NO: 226725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacaacacggtagcgtccgtatagtcctca

SEQ ID NO: 226726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacacactgtttgagtcttggcaattgagg

SEQ ID NO: 226727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacacgagacccagccataaccgtgaacgt

SEQ ID NO: 226728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacacggacccataatagttatgtccgtcg

SEQ ID NO: 226729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacagctaaagaactatggcatgggaagcg

SEQ ID NO: 226730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacaggactagtagcacaggtaattgaggt

SEQ ID NO: 226731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacataccttaccaaaggcctagtacgttc

SEQ ID NO: 226732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacatcacggcacatgtggttcagaatcgg

SEQ ID NO: 226733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacatttggtggctgttggtgacatgtctg

SEQ ID NO: 226734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaccagtatcatcccctcggtacattacat

SEQ ID NO: 226735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacccgtctgcaagtcgaccgttattcacg

SEQ ID NO: 226736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaccgttggtcccgattggctgtgcttatt

SEQ ID NO: 226737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacgataaccgaagctatcagcatatgtct

SEQ ID NO: 226738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacggcagcatactcaacgacccagtattg

SEQ ID NO: 226739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacgttgttctagctgtggggattctttcg

SEQ ID NO: 226740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaactgtagatcacacggacactgtatactc

SEQ ID NO: 226741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagaacacggcaggccgacaggagtatgtc

SEQ ID NO: 226742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagacacgttcgaagccggcagatctctct

SEQ ID NO: 226743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagactgagagttggaacggaacagattca

SEQ ID NO: 226744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagagaaatggtcccgagtcaggtcgctat

SEQ ID NO: 226745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagagaatatcaatagcggcaagaactgta

SEQ ID NO: 226746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagaggataaaaccacccctttgctacgac

SEQ ID NO: 226747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagagggggctaaaggagggcgaggttcta

SEQ ID NO: 226748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagataatgatgccaagactgctagccccc

SEQ ID NO: 226749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagatatggatagcgtagattttagtcact

SEQ ID NO: 226750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagatcttatagagttcgcgattccgacgg

SEQ ID NO: 226751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagatgtttgcagcctatatgtagattgtc

SEQ ID NO: 226752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagctagtttgcccaggaatatcctcgctt

SEQ ID NO: 226753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagctgattctttccgccggaagagcctcg

SEQ ID NO: 226754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagcttgagtattatgaagaatactggtga

SEQ ID NO: 226755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagctttgtacgggtgaatgcaaaccacgg

SEQ ID NO: 226756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaggacactagcgcgacgtgcaggcaggtg

SEQ ID NO: 226757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaggatctgagaatattcctatcgcagtct

SEQ ID NO: 226758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaggcctgaggggacaaatcgtgctactaa

SEQ ID NO: 226759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagggagatcccccgagcctccgtcccagg

SEQ ID NO: 226760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagggcctggaatctagtgtattcatcgtt

SEQ ID NO: 226761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagggctccgtcaatggacgtatttaaccc

SEQ ID NO: 226762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagggtagcatctttgatgcgttctgggtt

SEQ ID NO: 226763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaggtatctgctagccgaatatcatgaaaa

SEQ ID NO: 226764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaggtgggacattaatcgtcggcaatgttc

SEQ ID NO: 226765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagtactatctagggtggagcttcttatgc

SEQ ID NO: 226766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagtgttcccgtgtgcgcggaaggtgttgt

SEQ ID NO: 226767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagtttctcctgactcgtatctcggttgat

SEQ ID NO: 226768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatacagcgttatctggtgggtcacacggt

SEQ ID NO: 226769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatagggtagatagtcgtgcaatgccaggg

SEQ ID NO: 226770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatcttaaacggctgcactccttcattata

SEQ ID NO: 226771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatgacaccggcccctggtgaacccgactg

SEQ ID NO: 226772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatgcaattgcgggtcactaatgatgcttt

SEQ ID NO: 226773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatgctggatagcaatgggtcagcacacgt

SEQ ID NO: 226774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatggttatcccacctgtaaggacttcgtg

SEQ ID NO: 226775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaattgagtcggtggagacgtttgcgccacg

SEQ ID NO: 226776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaattgatgtttatgcggtgggattcaaagt

SEQ ID NO: 226777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatttactctttagcctgtaatgtttcgca

SEQ ID NO: 226778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaaatgttaaacatcgcaaagcaaatcgg

SEQ ID NO: 226779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaacgtcacgcttgaggattcgaatggct

SEQ ID NO: 226780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaaggtgcatggctatgtgggtgccacat

SEQ ID NO: 226781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaatgggtatatgtcaaaaggcgtcgaag

SEQ ID NO: 226782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaatgtgtcactcttttggagaccggttc

SEQ ID NO: 226783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacaaaggcttttggcacgttacgttccc

SEQ ID NO: 226784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaccgggtctagcggcgaatgctactcta

SEQ ID NO: 226785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacctcccgaataacggtaagcccccgac

SEQ ID NO: 226786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacgaacccgttttcacctgtttgaatgc

SEQ ID NO: 226787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacggcttgcaagtgcatattaagttgtg

SEQ ID NO: 226788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacactaccatcgcgcttgtacatttatatt

SEQ ID NO: 226789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacactacgacagctttagctattttcgaat

SEQ ID NO: 226790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacactcaaggtgatacggcagtacatggcc

SEQ ID NO: 226791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacactgacaaggcttactgttccgtacccg

SEQ ID NO: 226792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagagagtttttcacttgcaaagttggac

SEQ ID NO: 226793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagagcggacgataattgattaaaccaca

SEQ ID NO: 226794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagatattttatccatgtatcctctgctt

SEQ ID NO: 226795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagcatggtaagggcggcagatagaaagt

SEQ ID NO: 226796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagcggtgatcgggtaactttttgggacc

SEQ ID NO: 226797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaggcctcccctacggctgctcgaaccgg

SEQ ID NO: 226798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagggtacctcgatcggcggaggccttga

SEQ ID NO: 226799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagggttattctattggtgaggttgagcc

SEQ ID NO: 226800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaggtgctgatcttaggccgcgtggcata

SEQ ID NO: 226801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagtctttcttcaggatttggattaggta

SEQ ID NO: 226802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagttgactagcacttgcgctccgggtac

SEQ ID NO: 226803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacatagcctcgtatagactagcccacacat

SEQ ID NO: 226804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacatgggactttgatagccttccgtctcga

SEQ ID NO: 226805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacatggtgtagtgttggcgtacacctaact

SEQ ID NO: 226806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacatggtttacgcaaagcttatcaagtgtt

SEQ ID NO: 226807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacatgtaactccttttacgcaaagtattac

SEQ ID NO: 226808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacattgtgaaagtttacaagcttgttcagg

SEQ ID NO: 226809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacatttgcactaacacgggctttgggctca

SEQ ID NO: 226810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccaaatcaagactcgttcccatacatgcc

SEQ ID NO: 226811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccacagtcctgtcgtttccgctattgtgt

SEQ ID NO: 226812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccagtaggatagtcggtactattagtatc

SEQ ID NO: 226813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccagtattcaccgactcctctaatacaag

SEQ ID NO: 226814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccagtgttactactgatggggatgtttga

SEQ ID NO: 226815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccataaccccggtgtctccatccttaaga

SEQ ID NO: 226816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccatcgtctagctatttacgacggcccca

SEQ ID NO: 226817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacccagcttcaaggtgcccgccaatagagg

SEQ ID NO: 226818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacccttatccttcaggctcgatcttcgcgt

SEQ ID NO: 226819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccgccgtgacgtcaccgctcctgggtgtt

SEQ ID NO: 226820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccgccttgttgctgaatcgcgctacttga

SEQ ID NO: 226821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccggaagccgaggcggttagacatgttct

SEQ ID NO: 226822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacctctctgaagattgtaagtcgtgggaat

SEQ ID NO: 226823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacctctttacccgatacttgactaaggaat

SEQ ID NO: 226824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacctgacggtctgacggggggacgagccgg

SEQ ID NO: 226825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacctgcgtccgccgactagctacggcagcc

SEQ ID NO: 226826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacctgtagtggtgtctgtatgcacgctagt

SEQ ID NO: 226827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccttccccttcagcttagaaattactcgc

SEQ ID NO: 226828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgagatattacgacgtgctttaatacatg

SEQ ID NO: 226829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgagtgtaatgcagagttggaacgacatg

SEQ ID NO: 226830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcaccagccaatctttcgcaacgattta

SEQ ID NO: 226831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcactgtgatatacgattttgcgcccat

SEQ ID NO: 226832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcattaaacctgtagtgaggttctgaac

SEQ ID NO: 226833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcgccatactacgtaccccggtcagatt

SEQ ID NO: 226834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcgcgttgggtcaggggacctgggcagg

SEQ ID NO: 226835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcgtcgtgcactaggttgacgctcgccc

SEQ ID NO: 226836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggaagtggtaaatttcccggaatcgcgc

SEQ ID NO: 226837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggaataatttgcaacgaatctaggaggt

SEQ ID NO: 226838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggctccgatattatttgtcgtatgccca

SEQ ID NO: 226839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgggcaagttctacttaagttgcaaagcg

SEQ ID NO: 226840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgggttgaaaagcttactcttgtgggcga

SEQ ID NO: 226841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgtatgtggtttgatgtactatccgtcta

SEQ ID NO: 226842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgtcccgttgtggaacgttaaggtccggg

SEQ ID NO: 226843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgtcgcgtctccggataagcctggaatat

SEQ ID NO: 226844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgttaaataaatgtcgcgcatggggggcg

SEQ ID NO: 226845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgttaacagttttcaatggaacttgcctg

SEQ ID NO: 226846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgttgctcctcttgctttgttctcgttca

SEQ ID NO: 226847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgttttatagcgcaaactggaattccgtc

SEQ ID NO: 226848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactaaatacggctcgtcttgattctagggc

SEQ ID NO: 226849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactactaatctgaagcataataacacgagt

SEQ ID NO: 226850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactactgcgtattcatatgccgcattggga

SEQ ID NO: 226851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactagcatgaagatcccgcttgtgccgctg

SEQ ID NO: 226852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactaggggagattttatgggtgcgtagtta

SEQ ID NO: 226853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactattcattacagccttagtgcacccgat

SEQ ID NO: 226854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactcaacgccttgacaggggtgcaacggaa

SEQ ID NO: 226855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactcccggagtcacactactcttgggttaa

SEQ ID NO: 226856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactcccgtcatgacatagtttgtttaaggt

SEQ ID NO: 226857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactccgcttatggcccattacatgttagtt

SEQ ID NO: 226858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactcctacttactgttctcccgatacgccc

SEQ ID NO: 226859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactcctcggctagttgtagaatttcggggt

SEQ ID NO: 226860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactcgatcttgtctaataattactgttcac

SEQ ID NO: 226861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactcggaagagaactggactgatatgcctt

SEQ ID NO: 226862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactctcgatattgataaccttatttctttg

SEQ ID NO: 226863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactgctactcaagctctcggctacaggaat

SEQ ID NO: 226864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactgctcataggatttcgagtctccatgtc

SEQ ID NO: 226865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactggggttttacaatcgggcttacacgcc

SEQ ID NO: 226866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactggtaaatatcgtgggaaaggaacgcgg

SEQ ID NO: 226867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactgtcaaataaccgtgtagtactgcagtc

SEQ ID NO: 226868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacttaacgtcatgggttctgacgggtcgat

SEQ ID NO: 226869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacttaatcgttatacatttttactcttaaa

SEQ ID NO: 226870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacttccacgcttaaggacgcctccctcccc

SEQ ID NO: 226871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacttctttgggtcaaaaaatgagttagctg

SEQ ID NO: 226872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacttgccttatttgtgaattatttggacct

SEQ ID NO: 226873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacttgtaccatcactccctcttatttcgtt

SEQ ID NO: 226874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacttgtttatgtttgctcggtccaacttag

SEQ ID NO: 226875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactttcacctctccgataagctagctagct

SEQ ID NO: 226876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactttcactcggattccttaacggcggcat

SEQ ID NO: 226877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactttcatttaccgtagataattgaagagg

SEQ ID NO: 226878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactttgttaccctgaggattacgcaatgcg

SEQ ID NO: 226879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagaaagttttcctcttaattatatgagata

SEQ ID NO: 226880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagaattttaatatttactgtcgctagaatg

SEQ ID NO: 226881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagacaaggttaaacgggtgtgttcttcggc

SEQ ID NO: 226882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagacatgccgtagtgtcattatttgtccga

SEQ ID NO: 226883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagacattaagccccaccgttggcatccggt

SEQ ID NO: 226884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagacccttatggggctgtatttttacttgt

SEQ ID NO: 226885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagacctcctcattctacattttccctctgc

SEQ ID NO: 226886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagacgtttctagttactcgcgtggccggcc

SEQ ID NO: 226887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagagacccgggggtcctttacccaccgtgc

SEQ ID NO: 226888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagagatacctgatttgttgctctttgtaac

SEQ ID NO: 226889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagagattgatatgcaggtgcttcgaaaaat

SEQ ID NO: 226890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagagcgtgatcgcttggaaaggatggttct

SEQ ID NO: 226891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagaggcgggctttgatcagaaggagcccgt

SEQ ID NO: 226892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagagtgtttatactaggaaacggcgctggc

SEQ ID NO: 226893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagataaattcagcactccacaaatgctgtt

SEQ ID NO: 226894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagatagaggggtttggccggcccagagtgc

SEQ ID NO: 226895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagatagtcgccggctaggtctcgttccctc

SEQ ID NO: 226896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagatcgtccgtaatcctctctcgtatgcct

SEQ ID NO: 226897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagatgtttcaactatctgagagcaggcgat

SEQ ID NO: 226898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagattaccaagtgcaaatgtccctggtact

SEQ ID NO: 226899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagattcgataacataaacagctgtctaatg

SEQ ID NO: 226900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcaacgaattctctggatattctcaatgg

SEQ ID NO: 226901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcacagccaaggtgtggaagttcctttgg

SEQ ID NO: 226902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcatgtggctttcccatcataacacctgc

SEQ ID NO: 226903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcattagaaaatactctgttggctgcctt

SEQ ID NO: 226904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcatttatgttgctggttcgttagattta

SEQ ID NO: 226905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcccgcgttcttctggagcagatattcgt

SEQ ID NO: 226906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcctttgtcgtttcttcccgatctgtgga

SEQ ID NO: 226907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgaatgcttagtactgcataaaggttgt

SEQ ID NO: 226908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgggcatgggaaaaacatctgcaattcc

SEQ ID NO: 226909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgggttaactattcgacgagaaaaccat

SEQ ID NO: 226910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctacatggacagtacgacggcactctag

SEQ ID NO: 226911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctattggcagaaggttgttagtgcacac

SEQ ID NO: 226912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctctgacgtatgtttcagcgtgtacccg

SEQ ID NO: 226913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctgactttcgacctatttaaacgacacc

SEQ ID NO: 226914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctgagcgaatgcatctcttgagcattag

SEQ ID NO: 226915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctgatggtgatttattacgcagtattac

SEQ ID NO: 226916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctgggatctgtaatttcatggggtccgt

SEQ ID NO: 226917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctgtagtaccgcctcctcatggtgtcct

SEQ ID NO: 226918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcttagccgcccagatcttgtgtgttccg

SEQ ID NO: 226919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcttttggcgaatggagggccttgggtcc

SEQ ID NO: 226920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggaaaatcttgccgatatcacgcgtgtca

SEQ ID NO: 226921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggaccgtgttctttggcctggtcgagcac

SEQ ID NO: 226922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggactcgggcgctaaacaagccgctgata

SEQ ID NO: 226923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggagagtgttaaacaatgacgagacgagt

SEQ ID NO: 226924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggagtacagattggaaatgttaagctgat

SEQ ID NO: 226925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggagttctggggaaggaagtcagctaccg

SEQ ID NO: 226926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggatattattaggacgatcattttcttgg

SEQ ID NO: 226927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggcaataaggtagagaacaaacgttgaaa

SEQ ID NO: 226928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggcagccaatggcagggggatgttgggcc

SEQ ID NO: 226929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggcattacaccaatgcattatacgatgga

SEQ ID NO: 226930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggcggctaatagatcattgcccttctcat

SEQ ID NO: 226931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggactatccttatcttgtcggttccgtt

SEQ ID NO: 226932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggcatggcccaacttctgggcggcgatt

SEQ ID NO: 226933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggcatgtaagtgaatcagatttatcacg

SEQ ID NO: 226934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggctggctagtctggttcttttgtatga

SEQ ID NO: 226935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggggcaaagggtctcggacgaaagatcgg

SEQ ID NO: 226936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggggtagtaaatgctggaatctttaatct

SEQ ID NO: 226937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggtgggcctggtggacctgaccggatcc

SEQ ID NO: 226938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggtttttgctcccaatcagcatagggca

SEQ ID NO: 226939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggtcatctagtggtggttagctcacccca

SEQ ID NO: 226940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggtcatttcctcttatcatgtagttgtcg

SEQ ID NO: 226941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggtgtcatactgtaaaacttgtcttctat

SEQ ID NO: 226942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggtgttgttcattggagtggtggagtggt

SEQ ID NO: 226943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggttctagtatcgcttctctcagttcatg

SEQ ID NO: 226944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtaacagccggtagtcgtgctaaacttgc

SEQ ID NO: 226945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtaacgagaatcctcggtggcatccgtgc

SEQ ID NO: 226946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtacaaagttgatttctttatgtgctcat

SEQ ID NO: 226947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtacctctttgtttttgtttcgtctttgt

SEQ ID NO: 226948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtacgggacgctacatcttcgagagtctc

SEQ ID NO: 226949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtagtgattacaccatctcgatgcgacgt

SEQ ID NO: 226950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtatacggcgttgttgtgttagctctatg

SEQ ID NO: 226951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtatcaacgattgggctagttcatcgtgg

SEQ ID NO: 226952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtatcctagcttagtcagtggtagggtgc

SEQ ID NO: 226953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtcatgggtgtgctgcggggtttacgtcg

SEQ ID NO: 226954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtcattcgttcggtcctatgttttagtct

SEQ ID NO: 226955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtcggcggaagcactgaaatacggagccg

SEQ ID NO: 226956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtcgttatttgtgctctaactatagctag

SEQ ID NO: 226957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtctaaaaggcaccagccgtacatatata

SEQ ID NO: 226958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtgacacagcatttcgtttggccgtgttt

SEQ ID NO: 226959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtgacctccacctgcagggaggcaagtta

SEQ ID NO: 226960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtgccaggggttaattctcacgcatttgg

SEQ ID NO: 226961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtgccggctcttcaataagcgtgctggcg

SEQ ID NO: 226962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtgcttaaacaacggtgcaagggctccat

SEQ ID NO: 226963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtggcaatatctcgcggtgtcaagaacgt

SEQ ID NO: 226964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagttacgatcggcattaagttctactgagt

SEQ ID NO: 226965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagttcatgtttccaaatgaggaacggcaat

SEQ ID NO: 226966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagttgcagccaggacagctcgtagtgcacg

SEQ ID NO: 226967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagttttccaatgggttgtcggatgctgcgc

SEQ ID NO: 226968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataaaagctaacaacttctaagagagctta

SEQ ID NO: 226969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataaaatattcgggctgaatgtctgttact

SEQ ID NO: 226970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataaattcgtgggattgtctctaccttggg

SEQ ID NO: 226971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataacacgggactagtcggcggttggtgtt

SEQ ID NO: 226972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataacggattataacagaaagtcctaggtt

SEQ ID NO: 226973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataagtggatggctaagatatttagtaaag

SEQ ID NO: 226974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataatactcttggatgaacggggtgcaata

SEQ ID NO: 226975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataatgactctgtgtgtcacactccctcaa

SEQ ID NO: 226976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataattacagaggcactgggaaagtggtgt

SEQ ID NO: 226977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatacagccgcaattatgtatgcatgtcggg

SEQ ID NO: 226978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatacgtaagtacagtatgaagcttaatgcc

SEQ ID NO: 226979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatactgctaaatagaatcatagtccccggt

SEQ ID NO: 226980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatactgggtacggccagtgatgccccggtg

SEQ ID NO: 226981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatagccaccggaaatctcatcattcttcct

SEQ ID NO: 226982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatagccactgtaagtgctggagtgcgatga

SEQ ID NO: 226983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataggagactagcccatgacgggtgcaccg

SEQ ID NO: 226984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatagtattgtagtgattggtcggaaatgat

SEQ ID NO: 226985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatagttacataggtatacttgtgatgtctc

SEQ ID NO: 226986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatatcctgcggacacttacacgtgctgtat

SEQ ID NO: 226987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatatcttcattttctcggattttaccaatc

SEQ ID NO: 226988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatatgcaattgatgagcggggagggtattg

SEQ ID NO: 226989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatatgcatactgattgatgaggtacccgtg

SEQ ID NO: 226990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcaatattattcgtctttaactgtcgcca

SEQ ID NO: 226991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcacaccggggcggggacgaatctaacaa

SEQ ID NO: 226992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcagatttttcgtccgacgatctacgctc

SEQ ID NO: 226993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcagtgtatctacaaaagcactcaacacc

SEQ ID NO: 226994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcattcactttggcgttgcctcactttca

SEQ ID NO: 226995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatccagctaccgtattgcgtacctgccttc

SEQ ID NO: 226996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcccagcgcatgcggtattgaattcagct

SEQ ID NO: 226997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcccgtgggctgcctccttatttggttcc

SEQ ID NO: 226998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcctagggctctcttagttgtctgtcggg

SEQ ID NO: 226999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcgactgggtgttatcttaataacaagcg

SEQ ID NO: 227000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcgcggaaaatccaggcagaacggttcag

SEQ ID NO: 227001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcggccccgccctgtagtagaaacgcagc

SEQ ID NO: 227002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcgggattgatacggaaggcatgatgcac

SEQ ID NO: 227003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcgtgattcggttaacacgatcatctggt

SEQ ID NO: 227004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatctactcttgtctatgtctccgctggcta

SEQ ID NO: 227005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatctagttatatacggcgcctcacggtaga

SEQ ID NO: 227006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatctccaaccagggattacacttttgacga

SEQ ID NO: 227007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatctcgatagccgtgaatctcaccggcagg

SEQ ID NO: 227008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatctgtagtcctccgtgatatgatcactaa

SEQ ID NO: 227009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatctgtcaaccggcagatctgcaggcctct

SEQ ID NO: 227010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgaacaacccctaggcttgattcccgtgg

SEQ ID NO: 227011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgaacgctccgggggctaatccaaattgg

SEQ ID NO: 227012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgaatcgtggttaagtggaggttgacttt

SEQ ID NO: 227013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgaattcggctattgcctgttagtaaggt

SEQ ID NO: 227014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgacgaagtatttttgctgtacgcgcgca

SEQ ID NO: 227015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgaggaccacaccgcccaccagggagcac

SEQ ID NO: 227016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgattgtgtaagcctcacaggggtattgc

SEQ ID NO: 227017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcaccgttgtcagaggatagtggtggct

SEQ ID NO: 227018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgccgcgcgtatatcgctcgaatgctgtg

SEQ ID NO: 227019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcggagccaaactttcattttagggccg

SEQ ID NO: 227020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcggcgcacgctgggacggtggtcctcg

SEQ ID NO: 227021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgctccccgggggctggttaacacgggcg

SEQ ID NO: 227022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatggagatcccacaactaggtctcggggtg

SEQ ID NO: 227023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatggatctgcgaacgttctggtgatgtaat

SEQ ID NO: 227024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatggctatgcttcctcatcgtggtatgcat

SEQ ID NO: 227025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatggggatagaccagcgtggtacaagtcat

SEQ ID NO: 227026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgggggtactagacaggctcgtgtcgtcg

SEQ ID NO: 227027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatggtgacatacctcaacgaaaggcatcgt

SEQ ID NO: 227028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgtacaatcgggggcatccggattgggcc

SEQ ID NO: 227029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgtacatttgggtgttctccgtatccatc

SEQ ID NO: 227030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgtcacatctattcatgtttgatggtatc

SEQ ID NO: 227031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgtcatctgattttgttcccgcataactt

SEQ ID NO: 227032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgtcgaataatgaatcttcgtagcggaac

SEQ ID NO: 227033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgtcttagtatctaactggctgaacccta

SEQ ID NO: 227034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgtggagcaaagtgatctgactgtctttt

SEQ ID NO: 227035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgtgtactatctcacagctctctctcggg

SEQ ID NO: 227036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgtgtgctagcttcttgcaagacactctt

SEQ ID NO: 227037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattaatcgccttctattctaggtccaggcg

SEQ ID NO: 227038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattacaccggagaattcattatgtccaagc

SEQ ID NO: 227039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattagatcaggcattgtggagaaggtcgac

SEQ ID NO: 227040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattaggcgtcaaaatccagcggtaaaccct

SEQ ID NO: 227041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattatattcggtccgggtctttgctcctcc

SEQ ID NO: 227042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattatattgacccacagctgtgaatggtat

SEQ ID NO: 227043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattatcaccgttcctactttactgtcatct

SEQ ID NO: 227044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattattcacggttggttcgttttttggttt

SEQ ID NO: 227045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattcagtttgctccgttgttggtgggccct

SEQ ID NO: 227046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattcatgcgaaccaacctactaaatactag

SEQ ID NO: 227047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattccgctgctaggttattcagtccccttg

SEQ ID NO: 227048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattcgaatacttggatctctgcgggtacgt

SEQ ID NO: 227049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattcgcctgcaggggggcgacactaagtgc

SEQ ID NO: 227050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattctaaccgagtaaggcctacccaggtgg

SEQ ID NO: 227051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattctagcctgggatcaacattccaagtct

SEQ ID NO: 227052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattctcgccttattcgagcgcattggccgg

SEQ ID NO: 227053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattctgctcactccacagcatcctttcccg

SEQ ID NO: 227054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattctggcggtaaaaacggtttaggatact

SEQ ID NO: 227055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattcttttgagcttccatgtgacgcgggtc

SEQ ID NO: 227056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattgattatggcccgtttactatgtgcggt

SEQ ID NO: 227057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattgcatgctcgagctgctcgtactttatt

SEQ ID NO: 227058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattgcggtctgcctttgtcgtactactcgg

SEQ ID NO: 227059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattgcttttgaaaggtatatcgcctttctg

SEQ ID NO: 227060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattggctttttaccgactttcacagagcga

SEQ ID NO: 227061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattgggggagtgaatccccaggtagtcgag

SEQ ID NO: 227062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattgtgttatataggtcatgccgacgtatg

SEQ ID NO: 227063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatttaaagttatacgttgtttcgtagatga

SEQ ID NO: 227064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatttacacgaacgcgtgcatatcttgtcca

SEQ ID NO: 227065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatttacggtattccgccctacgtaacatat

SEQ ID NO: 227066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatttagtctcggttccatacactaggcggg

SEQ ID NO: 227067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatttagtgcactacaattgctttttgggcg

SEQ ID NO: 227068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatttccgtgcttccgaccaatatcctactc

SEQ ID NO: 227069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatttgtgattagtgacgcctttgtatttct

SEQ ID NO: 227070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattttaacggacggaacgaacgcggtcttt

SEQ ID NO: 227071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattttacgtgatatacgtgaggtatgggga

SEQ ID NO: 227072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattttctagcctcattcctgcctctccgcc

SEQ ID NO: 227073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatttttagtatcctgttcggatcttcgtgc

SEQ ID NO: 227074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatttttatgggcatagtactatgcgtacgg

SEQ ID NO: 227075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaaaggtctcttgtaaaggtcacaaggtct

SEQ ID NO: 227076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaaagtttacttctaacttccgccggcacg

SEQ ID NO: 227077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaaccagttagatgcgtttaggtcacactt

SEQ ID NO: 227078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaaccccttggtgtaggtgattttgtgtct

SEQ ID NO: 227079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaactttgtacgttgtagccagtctactgt

SEQ ID NO: 227080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaacttttgaccgccggtctgtcgttagcg

SEQ ID NO: 227081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaagcagattatcttcctttcctattatag

SEQ ID NO: 227082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaagccccgattggcttctaaaataatgag

SEQ ID NO: 227083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaagtgtaacgagccttcgccaggtgtggg

SEQ ID NO: 227084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaataaaaagcctataatggtggaactctc

SEQ ID NO: 227085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaataaaattgtttcggacttctcgagaac

SEQ ID NO: 227086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaataccatcagcattctgcgtatttactc

SEQ ID NO: 227087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaatgcatacccaattccctgctgtattag

SEQ ID NO: 227088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaattgaagcggctctccgatgtcgtagta

SEQ ID NO: 227089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacaacccgggcctgctcctatctaaacct

SEQ ID NO: 227090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacaacttacagcttcgtagcctgcttgcg

SEQ ID NO: 227091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacaatcttggccggcctgtgcgacaggat

SEQ ID NO: 227092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacattcccgaacggcttcccgcaaggttt

SEQ ID NO: 227093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacatttgtactggaatggtgcgttgttgc

SEQ ID NO: 227094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaccactacattgggacgctggtgcttatg

SEQ ID NO: 227095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaccaggtttagctcactacgctcgtgatc

SEQ ID NO: 227096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaccggcgttactgcagggctgtcagcgct

SEQ ID NO: 227097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaccgtctccactccctttcacctgtttgt

SEQ ID NO: 227098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgccctgctttctcatgggggagaaatg

SEQ ID NO: 227099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgtccttcttgcttccagaatgttactg

SEQ ID NO: 227100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgttcctaaaccctatcgaaactgtcca

SEQ ID NO: 227101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgtttcagttcgaccgtccacaagtatt

SEQ ID NO: 227102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccactagcacactaggggaagtatccggtgt

SEQ ID NO: 227103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccactctttgttacgatcccggcactttaca

SEQ ID NO: 227104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccactggtcctggcttggggagaaagggtac

SEQ ID NO: 227105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccactgtgggatggacgtggtgccggccatt

SEQ ID NO: 227106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacttcccgacacatgtgttcccccggtcc

SEQ ID NO: 227107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccactttggcggggctaaagagtatcgttaa

SEQ ID NO: 227108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagactcgccagaccctttaacggttcatc

SEQ ID NO: 227109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagacttagcgctagcttttccagccgaac

SEQ ID NO: 227110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagaggtagggcggttaggcatgtccgatc

SEQ ID NO: 227111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagataagtgcatcttaatccaaactcggg

SEQ ID NO: 227112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagatcgttgtgcaggggcgaggttcctta

SEQ ID NO: 227113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagccaccggcatattttaaccactgctgg

SEQ ID NO: 227114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagcctcagtcgaacagcggatgctcggtc

SEQ ID NO: 227115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagcctggactacgccatacggcaataccg

SEQ ID NO: 227116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagcgctctggctgtaaataccttacctgc

SEQ ID NO: 227117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagcgtgatttaggtcctcgcgtgactttt

SEQ ID NO: 227118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagcgtttaatgggtcttttatttggattt

SEQ ID NO: 227119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggaattcccagtggctaaggtgcacacc

SEQ ID NO: 227120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggaccaatcatgtgcgaaatccttgcgc

SEQ ID NO: 227121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggagaattgttagagagaaccctgaggg

SEQ ID NO: 227122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggattattaaatactcacgatatctggc

SEQ ID NO: 227123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggcaagttcctgggtgctgattcgctcg

SEQ ID NO: 227124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggcatgtataataatcttggtcgccctt

SEQ ID NO: 227125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggctactttactcgattagcgattggtg

SEQ ID NO: 227126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggggagaaggatgtgaggcggcaatacc

SEQ ID NO: 227127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagggtagttccttattgtctgagcacggt

SEQ ID NO: 227128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagggtgtttgggagctcagtactcacttg

SEQ ID NO: 227129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggttgtggaacgccccgggctcaggctt

SEQ ID NO: 227130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagtaattagccggacggcccaatcttata

SEQ ID NO: 227131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagtcatgcttagaaaccaacgcgccagca

SEQ ID NO: 227132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagtgagtgattggagactatatcggctgc

SEQ ID NO: 227133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagtgcaaataattgccgtcatcgggctgg

SEQ ID NO: 227134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagtgctcagatctgccttggaagggggta

SEQ ID NO: 227135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagttagcaatattcttttgtctaatctca

SEQ ID NO: 227136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagttgaccccgtcgaactcggggattccc

SEQ ID NO: 227137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagtttcatagtttacaagaaggtgaacgg

SEQ ID NO: 227138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagtttgcgttctcgtatttagatcattct

SEQ ID NO: 227139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagttttgcctgtaattactactaccccgc

SEQ ID NO: 227140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccataagatttgtttgccggtagggcgcagc

SEQ ID NO: 227141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccataatgccgtgatggtccacgatcgatac

SEQ ID NO: 227142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccataattggttgacataagtggattccgcc

SEQ ID NO: 227143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccataggtgctggtgctcctcgacgcgcgtt

SEQ ID NO: 227144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatattttcctcttgtcctatacgcgttcg

SEQ ID NO: 227145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatcaatctttgggaaagctattgtagtgg

SEQ ID NO: 227146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatcaggggttctgatctgttaaaggatcc

SEQ ID NO: 227147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatcgaaagtcccaagtgcacccgtagatg

SEQ ID NO: 227148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatcgaacatctggtattagagaggcgcct

SEQ ID NO: 227149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatcgattacccggcacgatcccttcttta

SEQ ID NO: 227150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatcgggcgcatcggtgtattttcctgacg

SEQ ID NO: 227151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatcgtggacaaacggacaatgctatttgt

SEQ ID NO: 227152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatctaagtatacgacccttgtactcctcc

SEQ ID NO: 227153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatctgcggcttaactatccaggctctctt

SEQ ID NO: 227154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatgccagaccgccttacgtactcgggggc

SEQ ID NO: 227155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatgctattaggtatgtgcgttacacttaa

SEQ ID NO: 227156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatggatcgaaccgccaagttcggtgtgct

SEQ ID NO: 227157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatggtgcgtaggccccgaccatttggctc

SEQ ID NO: 227158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatgtgcgatttgactgtcttcccttagat

SEQ ID NO: 227159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatgtgtttccctacatgataaggaaagac

SEQ ID NO: 227160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccattatccggcctggaactgtcttgctctt

SEQ ID NO: 227161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccattcagtttttctttctgattggtttgtt

SEQ ID NO: 227162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccattcctggtcgtacacattccgtagttcg

SEQ ID NO: 227163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccattgaccccatcgtttcgtaagttgcatc

SEQ ID NO: 227164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccattgccccgatgtattattcggatttgta

SEQ ID NO: 227165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccattgctccaagatggctagacggcgtgtg

SEQ ID NO: 227166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccattgggcgaatcgtatggtttctcctcat

SEQ ID NO: 227167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaaaggtatagtcattagctgtctagtag

SEQ ID NO: 227168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaaaggtgtgtccggcttggcacgggatt

SEQ ID NO: 227169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaacttttgaccagtgtctagcggtgtaa

SEQ ID NO: 227170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaattctatccgtcctctgcaactgtcct

SEQ ID NO: 227171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacaaatcccatccgaatgaccgttccca

SEQ ID NO: 227172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaccaattggtgaagtattctatgtcctg

SEQ ID NO: 227173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacctttcatactatgtgccttccatggt

SEQ ID NO: 227174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacgccacagctatatagacaggccgtca

SEQ ID NO: 227175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacggtttggcgcgctctcttattagacg

SEQ ID NO: 227176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccagaagcgtaactcaagccgtgttaggtt

SEQ ID NO: 227177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccagcgtgaaagagcggcaccgtcatctct

SEQ ID NO: 227178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaggctgattcccgatgagacttcccgcg

SEQ ID NO: 227179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccagggtacatgccgcaagatacgtccttt

SEQ ID NO: 227180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccagtgccacatggtgttgggctgagcaac

SEQ ID NO: 227181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccagttttgttgatcggaaaagtcgaggac

SEQ ID NO: 227182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccatctagagggaaggccttgctgcgcgcc

SEQ ID NO: 227183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccatcttttattgctccctacaattgtggt

SEQ ID NO: 227184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccatttgcggtgcggtttcggcattccact

SEQ ID NO: 227185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccatgaatcttcgttcgcttcggctcact

SEQ ID NO: 227186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccattcgactagtatcgttaatgcttgta

SEQ ID NO: 227187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccatttaaggggcatactagacgtaatcg

SEQ ID NO: 227188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccattttctggcagcaaacagcccctatc

SEQ ID NO: 227189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccccacgccgctcctattttcttaatagtg

SEQ ID NO: 227190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccccgacaatattgaccgcgcgtaagagga

SEQ ID NO: 227191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgagttagtacgatgtgatgcgcgccat

SEQ ID NO: 227192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgattcccacagtaaataacgtgggcta

SEQ ID NO: 227193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgctcccggttgctagagtgtccttgcc

SEQ ID NO: 227194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgcttcagtaatttcctggcacaactaa

SEQ ID NO: 227195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccggaaacggtttaacacggtgtgataaa

SEQ ID NO: 227196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccggtatcgcacaataaacgtgattttac

SEQ ID NO: 227197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccggttgtggccgatgcgctgactttagg

SEQ ID NO: 227198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgtaaaggagaaacagccagggatttgc

SEQ ID NO: 227199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccctccgtactattactctcctatctcggc

SEQ ID NO: 227200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccctcgactattcgtgttctttccgcttgc

SEQ ID NO: 227201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccctcgcagcatttgtccctcgttgactac

SEQ ID NO: 227202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccctctcgtcaaactattgcgtgaggacgc

SEQ ID NO: 227203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccctcttctatctgcgtgcctggtccagtt

SEQ ID NO: 227204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccctgcgattagcgattcactccgttggaa

SEQ ID NO: 227205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccttagatatataattttcacataaggga

SEQ ID NO: 227206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccttcgttactcatacctcaacctcagcg

SEQ ID NO: 227207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgacaatgtaacaatcttatgtcgtcact

SEQ ID NO: 227208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgaggcaacgcgttgtgaatttaacacta

SEQ ID NO: 227209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgagggttcgcttagtattcattttggtt

SEQ ID NO: 227210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgagtgctcctaactcgttgtattctctc

SEQ ID NO: 227211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcatgaggtggtcattcccacttcattt

SEQ ID NO: 227212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcattattcatgtattaacagtgaacgc

SEQ ID NO: 227213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgccagatggcgtctggactagccatcat

SEQ ID NO: 227214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgccggactaagtacattattatgttacg

SEQ ID NO: 227215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgccgtcgcgttctggaacgacctcatcg

SEQ ID NO: 227216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcgagctcactgatcacatatggtctaa

SEQ ID NO: 227217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcgggtcgacggtttgactgctactaaa

SEQ ID NO: 227218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcgttatgtcacgaaagctcttaggcct

SEQ ID NO: 227219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgctgtacggggatattaggtcttccgta

SEQ ID NO: 227220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcttaaggtagattattcttggggatcc

SEQ ID NO: 227221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcttctccggactgaccaccctgcttat

SEQ ID NO: 227222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggaggaaggttgggtttttcggtgcatg

SEQ ID NO: 227223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggattaaattaaatctgtaatcatcctt

SEQ ID NO: 227224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggcgaacctttcttagacatttcaaaaa

SEQ ID NO: 227225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggcgagtttcttcgtgccctttggttgt

SEQ ID NO: 227226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggctctgggtgtacgtaccttcctgcat

SEQ ID NO: 227227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgggaagaaacgcacattcaattggggga

SEQ ID NO: 227228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgggagttgtgagaacccttgatgacctt

SEQ ID NO: 227229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggggcggccggtcgtcaaaaaacctttg

SEQ ID NO: 227230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggtatgaaagcggacatcgcttttcgat

SEQ ID NO: 227231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggtctaaccatagttacaacccgtattc

SEQ ID NO: 227232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggtctttaacgccgcgttctaagatgca

SEQ ID NO: 227233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggttagtctttgcaccttcctcctcatc

SEQ ID NO: 227234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtataggctggccctaccttcccggtgt

SEQ ID NO: 227235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtcatgttcgcatctacaaagatcgcta

SEQ ID NO: 227236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtgcatccatatcgggtttatcataccg

SEQ ID NO: 227237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtggttcaactctatttgtgttatcgta

SEQ ID NO: 227238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtttgattggtaaaaaaggggcccgctg

SEQ ID NO: 227239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctaagcagtagtaccgcttcgcccgcgtg

SEQ ID NO: 227240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctacgcttcgtgctataaaggcggaaggc

SEQ ID NO: 227241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctacttttaggggaaggacgtgttcataa

SEQ ID NO: 227242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctagaaggtcctgacgacatgttctacct

SEQ ID NO: 227243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctagctcgctagattagcccggtgcggat

SEQ ID NO: 227244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctagtatttaacacaatctattctactgg

SEQ ID NO: 227245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctatacactgacactcttgggtctggcac

SEQ ID NO: 227246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctatcacggtgaaccaatgattgaatccc

SEQ ID NO: 227247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctcagaaagcattatctgtttgtccactt

SEQ ID NO: 227248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctcaggtggtcttaacaaaacgtgttcgc

SEQ ID NO: 227249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctcctcgacaagtagaaatgggctttaat

SEQ ID NO: 227250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctcctgttagacgagttgctttcgtgtcc

SEQ ID NO: 227251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctcgttaaatttcaggaagggagactatt

SEQ ID NO: 227252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctctgtgtcgtttcgtgctcaggcattgt

SEQ ID NO: 227253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctgaagccctggtaatatacagatggacc

SEQ ID NO: 227254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctgatgcgtacgcagacattttactggcg

SEQ ID NO: 227255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctgcatcgcgtggtatagcttctcttacc

SEQ ID NO: 227256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctgtgtagttctaggcactcgaagtcccg

SEQ ID NO: 227257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctgtgttgttactctacggatcccattcc

SEQ ID NO: 227258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctgttgtataatagaaccggacacggtcg

SEQ ID NO: 227259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccttacactttcactgttgtctaagtacaa

SEQ ID NO: 227260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccttatgcgctgcgggatattagccctccc

SEQ ID NO: 227261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccttatttaccagggatgtgtttaataatc

SEQ ID NO: 227262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccttctgttcaatcaggtagccggagtacg

SEQ ID NO: 227263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccttgcgttggggaggcttagatggttgtt

SEQ ID NO: 227264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctttcttgtacgtggcgaaaagtctgggg

SEQ ID NO: 227265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccttttatagcattacattaactcccgttg

SEQ ID NO: 227266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccttttcacccaggaaaggtgctctcatct

SEQ ID NO: 227267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaaacagccagtaaagctattcgaggggc

SEQ ID NO: 227268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaaagatcgcacagaacgaacattttgtg

SEQ ID NO: 227269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaatctcattatcgccggttttcgggtgt

SEQ ID NO: 227270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaattggggaccagcgcgactttgtcagg

SEQ ID NO: 227271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaccacatgaagagttttatatctgtgcc

SEQ ID NO: 227272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacccagtgtactttcccttttacccgac

SEQ ID NO: 227273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgactggtgagatatgatagggtcgatccc

SEQ ID NO: 227274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgagcttatagctatctcatgatccgggtg

SEQ ID NO: 227275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaggtgatacggggtgtccgtggtagaca

SEQ ID NO: 227276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgagttgctagggattgtgatctctagatt

SEQ ID NO: 227277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgatactgaaatttttcaccatcgggatat

SEQ ID NO: 227278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgatcacgtgtctggattattgagctcgcc

SEQ ID NO: 227279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgatccaggggacttcgctgaaaaatcggg

SEQ ID NO: 227280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgatccatgcagtatttgacactatggact

SEQ ID NO: 227281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgattttttcgtatttcgtataacatttta

SEQ ID NO: 227282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcaacagtattattccaatccgatattac

SEQ ID NO: 227283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcacacaaagttcttaggtcgacctggtg

SEQ ID NO: 227284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcaccccgtcctgttagctcagtaggtgt

SEQ ID NO: 227285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcacgctaccctgggaacgcccgcaggta

SEQ ID NO: 227286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcagggtcttttattcatatcagtcccac

SEQ ID NO: 227287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcagtccacatcactctttagtacacata

SEQ ID NO: 227288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcatcgccgccacggtcttcaccacacgt

SEQ ID NO: 227289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcatgtatgagaccggcgtgttcttacgt

SEQ ID NO: 227290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcctcctttttctgggacgtgctacatta

SEQ ID NO: 227291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcctgctccgcgattgttcaccggcctca

SEQ ID NO: 227292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgagatgtataaagacacagcgtttacg

SEQ ID NO: 227293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgccgtagcattttgtctgctatcggtg

SEQ ID NO: 227294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgcgaaagctataaactttttcagttct

SEQ ID NO: 227295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgcgtgccgggtttgttgcttgttatga

SEQ ID NO: 227296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcggcttcgtcagatcataatgtaggcgt

SEQ ID NO: 227297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgggattatgcctttctgttatctgtga

SEQ ID NO: 227298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgtacatacctactgctaggcacggcgg

SEQ ID NO: 227299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgtcagcgaggtttttcgttaccgacta

SEQ ID NO: 227300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgctcagcagcctaacttattagaaatcta

SEQ ID NO: 227301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcttctgagagatataggggcgcgcagtc

SEQ ID NO: 227302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcttggcatttcattttggctggattaag

SEQ ID NO: 227303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcttgtctcatgacgcttcattaacttca

SEQ ID NO: 227304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggaaaaacggtgcgcccgcctcacttgca

SEQ ID NO: 227305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggaaaaggagctatatggtcctgtcgcct

SEQ ID NO: 227306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggataggttctcggcattccgtgtggtac

SEQ ID NO: 227307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggatttgtttgctgtgacactaatcactc

SEQ ID NO: 227308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggcaagatgggagcgtcaagttcatccct

SEQ ID NO: 227309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggcaatcacaatgcgtgtggttaaggtgg

SEQ ID NO: 227310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggccccttactctacctgtaccgcctatg

SEQ ID NO: 227311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggccctaccccctatcgtacgtggtttgg

SEQ ID NO: 227312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggccgttgatcgggcaactttgcctgtta

SEQ ID NO: 227313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggctccatttgagcgcgtccttttgacgg

SEQ ID NO: 227314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggcttgttgtgtttcgttccacgctggtg

SEQ ID NO: 227315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggagctactttcgtcttgccacgtcggc

SEQ ID NO: 227316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggatgtacattttagaactgcatgttag

SEQ ID NO: 227317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggcatccttcgttagatactgggttgtt

SEQ ID NO: 227318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggcatgtctttagttacaggtacgtttg

SEQ ID NO: 227319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggcccctcttttggttacacttcgctgg

SEQ ID NO: 227320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggcggtgaataagtacgcgctgctgcga

SEQ ID NO: 227321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggctgtgttccctgtaactcggtggttc

SEQ ID NO: 227322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggtcaggccagacacgattggcaggatg

SEQ ID NO: 227323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggttgatatggtccggtgtatggtggga

SEQ ID NO: 227324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtactttttctgttcatccactagccgg

SEQ ID NO: 227325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtcatgcttgattcctggtacctccccg

SEQ ID NO: 227326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtccgtgtaccattgtgttaggacatcg

SEQ ID NO: 227327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtcctccatagatagtaaattgaagcaa

SEQ ID NO: 227328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtctcggtaccgcactggaaacctggtc

SEQ ID NO: 227329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtgcggcgtcttgagcatatatggcgct

SEQ ID NO: 227330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggttaactgctttagtgcaacgtgactgc

SEQ ID NO: 227331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggttcctctagccttgtaccttcaaacta

SEQ ID NO: 227332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtttcctcggcgtattcgcccaagtgga

SEQ ID NO: 227333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtttgcagtgcacgttggtatacattct

SEQ ID NO: 227334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtttgtagcgttaagatttatccaggcg

SEQ ID NO: 227335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggttttcatcgcaccatttagaagggtgc

SEQ ID NO: 227336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtagttttgctactctgcttgggtcccac

SEQ ID NO: 227337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtataggtttattggcgcttcgtaacatc

SEQ ID NO: 227338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtccaccgtgaccgtaggaggcagcagct

SEQ ID NO: 227339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtccattttttacagtgcttagaagtcct

SEQ ID NO: 227340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtctatcacattcatccagatttgcttgt

SEQ ID NO: 227341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtctgtatgattcgcaccatttgaatccc

SEQ ID NO: 227342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgaacaggagaggacgccagcagtgcac

SEQ ID NO: 227343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtggatgcgctgagatgggcaagctctag

SEQ ID NO: 227344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtggttcattcccggtctatagggctgct

SEQ ID NO: 227345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgtcgtgggcgagctccattggcaacgg

SEQ ID NO: 227346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgttactaatgccatggtcagggcccca

SEQ ID NO: 227347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgttgcattgagtctcatgcttaatgct

SEQ ID NO: 227348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgttacctggagaagaagtgtcccgatggt

SEQ ID NO: 227349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgttcagtctatgtttgcccccagggttct

SEQ ID NO: 227350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgttgacgcgttatctctactttgccatgc

SEQ ID NO: 227351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtttcttaggcgatctctgtttcacgtct

SEQ ID NO: 227352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtttgttcgcgcccggcctttttctccat

SEQ ID NO: 227353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgttttcaaggcgatgctgaacgagttcgg

SEQ ID NO: 227354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtttttactcctacggatcgggtaaaact

SEQ ID NO: 227355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaacccatttattgcgcaattatgccgaa

SEQ ID NO: 227356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaaggtgctgaacttctatttactatggc

SEQ ID NO: 227357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaatagccccaacgtgtattaagcgcacg

SEQ ID NO: 227358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaatcccatgctgcgtacttacaaactat

SEQ ID NO: 227359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaatgaagttggtcaaaatcgaacggagt

SEQ ID NO: 227360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctacgcgcgggctgttgttactgtgtggcc

SEQ ID NO: 227361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctacggttgccacccataacagtcagggcg

SEQ ID NO: 227362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctactttgtgtgagcaggttacgaactggg

SEQ ID NO: 227363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctagcctaaatttcaggcgcttcgttataa

SEQ ID NO: 227364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaggagcgtggccaacgatttggttagag

SEQ ID NO: 227365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaggcaaatgtcaatcgcgcactgcgtgg

SEQ ID NO: 227366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctatacggctgccggcttgcgcctgtgcta

SEQ ID NO: 227367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctatagcttgctccgtgcttctggtattac

SEQ ID NO: 227368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctatagtttctacattacttttgcatgtcg

SEQ ID NO: 227369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctatgcagcggtgtggcgtgttgtggcgat

SEQ ID NO: 227370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcaaggtaatcttaggtgtctgctgttta

SEQ ID NO: 227371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcacgtgacgtgctactaggctatggcaa

SEQ ID NO: 227372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcataggttcaaccttaatcctagggcgt

SEQ ID NO: 227373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctccgcgggatttagcatctttttgtagtt

SEQ ID NO: 227374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctccggaaagtcaggtgtggcggggtgtga

SEQ ID NO: 227375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctccggcagtgcacgcatagaactgggcgg

SEQ ID NO: 227376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctccggtctcgcgcttgtatagatatccgg

SEQ ID NO: 227377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctccgtacgtggttggttatgacatgctgt

SEQ ID NO: 227378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctccgtgttcggactccttctccggcgagt

SEQ ID NO: 227379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctccttcacgacatgaacccggatcttacc

SEQ ID NO: 227380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcctttattctggttgatattttcctata

SEQ ID NO: 227381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcgactgagccacgggaaagttactcgtc

SEQ ID NO: 227382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcgatgtttacggggcatggtctcggact

SEQ ID NO: 227383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcgcgtaatgacggtttatgcgtgggtgt

SEQ ID NO: 227384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcgctggtactttgtattggggatcgtcg

SEQ ID NO: 227385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcggcctgatcactttaaccggtagcgcc

SEQ ID NO: 227386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcggcgctacattgcttgtgggatctcat

SEQ ID NO: 227387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcgggcgcaaagaaggagagatccggctc

SEQ ID NO: 227388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcgggtatgcaaatcactctcggtttacg

SEQ ID NO: 227389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcggtaccgattttcttatctttaggcta

SEQ ID NO: 227390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcgtagccgatcaccaagggtaataggat

SEQ ID NO: 227391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcgtcttagtaatgacatcgtgttatcct

SEQ ID NO: 227392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcgtctttgccatagccctggtggaactt

SEQ ID NO: 227393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctctagtacattgtgcaagccagctttgct

SEQ ID NO: 227394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctctatatctctcgaaatggaagtttgtga

SEQ ID NO: 227395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctctcgctgttctccaagcgtaagatacgg

SEQ ID NO: 227396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctctcgtaaaccaccgtgtgggagtagctc

SEQ ID NO: 227397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctctctcgagtaggtataggctcgggtgtg

SEQ ID NO: 227398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctctcttcctgttatgtgttataccggcca

SEQ ID NO: 227399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctctgatgatgcctgatgacctgggtgttt

SEQ ID NO: 227400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcttcgggagatgccatctgatgtcgggg

SEQ ID NO: 227401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcttggtcagcggacgatgcccacttggg

SEQ ID NO: 227402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcttgtatctccaactttcacgttgctcg

SEQ ID NO: 227403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcttttcttgcgtatgcgaatgctgacgt

SEQ ID NO: 227404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgaaaagtactgcttagcttgtccctgtc

SEQ ID NO: 227405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgaagatcaactttttaatttgtcatccc

SEQ ID NO: 227406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgacggggtatcttctctgctttttgtca

SEQ ID NO: 227407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgacttaccttccgctgttatgcatgttt

SEQ ID NO: 227408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgaggatcaattattcggatagccgcgcg

SEQ ID NO: 227409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgatagtttgatagtcggcattggtagtt

SEQ ID NO: 227410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgatcagttggtacatctaggattatgta

SEQ ID NO: 227411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgattcacctagtttcacctccgagggat

SEQ ID NO: 227412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgcaatcttgataatttcaccgtcaacgt

SEQ ID NO: 227413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgcccctagcccaccgcagcttccttgca

SEQ ID NO: 227414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgccgagaggtaaggactgtgcacacgtt

SEQ ID NO: 227415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgccttgccgcaacgaatctgcgtataga

SEQ ID NO: 227416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgcgtgttttaattagaccgtctgatatg

SEQ ID NO: 227417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgcttccggcaagacagaggtcagtccga

SEQ ID NO: 227418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggacgttgcacgatagaggcttgtttaa

SEQ ID NO: 227419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggatatggtcacttaggagcagagcgtg

SEQ ID NO: 227420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggcattgagtgttggaacctttctttag

SEQ ID NO: 227421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggttaaaagattttgaaggaataagggc

SEQ ID NO: 227422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggttcgtggatccgtcttcagatgaact

SEQ ID NO: 227423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgtacacgctttccaatcgaccgtttttc

SEQ ID NO: 227424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgtagatttcacgtaatcattatgcgtgc

SEQ ID NO: 227425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgtaggaggaccatgtcattacggcttgg

SEQ ID NO: 227426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgtcacccgtcgggggagggggtcactgt

SEQ ID NO: 227427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgtcgggtcactgcacttggcctttttgc

SEQ ID NO: 227428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgtctacttcttacaccgatttcttgatg

SEQ ID NO: 227429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgtctccgctactggataacaaactctct

SEQ ID NO: 227430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgtgtaagtacatagtaccccttttcgcg

SEQ ID NO: 227431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgtgtagtgcgctcggtgtcatacgggct

SEQ ID NO: 227432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgtgtccttgacattgcaatggctcattt

SEQ ID NO: 227433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgttactattcgtcagcaggcagagggtg

SEQ ID NO: 227434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgttcctgcttaaattcttatggctcgtt

SEQ ID NO: 227435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgttgcccaactctttctgaccggaatac

SEQ ID NO: 227436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgttttagcactttattgacgattaggct

SEQ ID NO: 227437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgttttgcggtaacatcgcataatgctga

SEQ ID NO: 227438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttaacgccatgagcaacgtccttaatttt

SEQ ID NO: 227439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttaactcgctcctcgcatagaattcgaag

SEQ ID NO: 227440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttaatctacgagtcgcctggtttgaccac

SEQ ID NO: 227441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttacattcattcccgatattatcactttc

SEQ ID NO: 227442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttacgcaaggttagaaggcattatgtcga

SEQ ID NO: 227443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttacgcctggtggtagctgtgtgacagtt

SEQ ID NO: 227444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttagtaggtttttcagcacttgggtgtga

SEQ ID NO: 227445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttagtgcattctactttcccctcacatac

SEQ ID NO: 227446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttatgatcagttattccttcttgtgcttt

SEQ ID NO: 227447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttatgtcatttcacggcagaccagccttg

SEQ ID NO: 227448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttattaacgatggacttcccttgcgttgc

SEQ ID NO: 227449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttcatgttaccatttcagtagtaggtagc

SEQ ID NO: 227450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttccagaagatagactagtcatcaatcgt

SEQ ID NO: 227451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttcccaaaccgttgttaacagctgtgccc

SEQ ID NO: 227452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttcccgtccgtgcgcgacgcgtgcatctg

SEQ ID NO: 227453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttccgacatctttcgacatggacgttgcc

SEQ ID NO: 227454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttctctaactttcaccaacgctgcagtct

SEQ ID NO: 227455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttctctgcgcttggaagcccagcacatcc

SEQ ID NO: 227456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttctttacacgaacgatactgccgactca

SEQ ID NO: 227457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttgccggtactgaatttgattaggaatag

SEQ ID NO: 227458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttgctttaatgtttccagatccggcaccg

SEQ ID NO: 227459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttgggacttgccatcttagtaactgatgg

SEQ ID NO: 227460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttggttaagacgtgccgctagctgcgccc

SEQ ID NO: 227461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctttacccacgtacatgttttgtcaaccgt

SEQ ID NO: 227462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctttactcatccgtagcctatttcttctct

SEQ ID NO: 227463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctttactctgatccgatttccacctaatgt

SEQ ID NO: 227464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctttcaggcatggtattacgacttgggaaa

SEQ ID NO: 227465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctttccagttggcactcattttttttcgaa

SEQ ID NO: 227466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctttcgatttcttatactgtcggtatgtcg

SEQ ID NO: 227467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttttattatgcgtgaggcacttgttatcg

SEQ ID NO: 227468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaaactagattgaacgtctggttttcggt

SEQ ID NO: 227469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaacccgcccattggtaatagggtataac

SEQ ID NO: 227470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaaccgaatgtggtgcttgggacatcctg

SEQ ID NO: 227471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaacgcggctcatacggtgcgatggcctt

SEQ ID NO: 227472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaagggctactccgccccatagcagtgta

SEQ ID NO: 227473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaacaaagtatgtagcgacactggagttga

SEQ ID NO: 227474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaacatcatcatagcactttctgtactact

SEQ ID NO: 227475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaacatcccactcactcgcttccttgccga

SEQ ID NO: 227476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaccctgccgtctgacgtgagaagcctgt

SEQ ID NO: 227477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagagaggctcatgtaccgtatgtcgtta

SEQ ID NO: 227478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagatagtagggtgcccaaagactcaggc

SEQ ID NO: 227479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagatgtcagtactaaatgttcatctggc

SEQ ID NO: 227480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagggaccgaactcgaacacgtttttgta

SEQ ID NO: 227481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagtaaactgcggtcatatagccaacaaa

SEQ ID NO: 227482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaatatgcgcatagaaaggccgatatagca

SEQ ID NO: 227483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaatttccacttaccactcctccgatcccg

SEQ ID NO: 227484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacaacgtttcactacccttattccagtaa

SEQ ID NO: 227485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacaattgtcgaagtaaccgtgattcggat

SEQ ID NO: 227486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacacgatcggtggcagttaaacacgatta

SEQ ID NO: 227487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacacgcgtcgtccccaacacggcggacgt

SEQ ID NO: 227488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacagtcctgagttgtgggagcgcatgtag

SEQ ID NO: 227489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacagttcgatccaccctcacgtgcgctgg

SEQ ID NO: 227490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacatcagccgattgcttcactatcgcgtc

SEQ ID NO: 227491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacatgttacgtaaggcgttgttatcggtg

SEQ ID NO: 227492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaccagtatacaggctttcgtgaacactcg

SEQ ID NO: 227493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaccatcatatcgtcctacgggacaaacat

SEQ ID NO: 227494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaccatcgtcatgctaaaactgccttcatc

SEQ ID NO: 227495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacccaggcgattataggggatatttccgg

SEQ ID NO: 227496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaccccgcaagcacgactcgagggaggtag

SEQ ID NO: 227497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaccgccccacgtttcccgcttctactgct

SEQ ID NO: 227498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaccgtgtgggccggggaaggtgagggggg

SEQ ID NO: 227499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaccgttcactcgccacgtggcctactagg

SEQ ID NO: 227500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaccttcaaatttaggcctttacggctttt

SEQ ID NO: 227501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgcaaagtggagggagatcccagtttaa

SEQ ID NO: 227502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgctgcggtaatggcacgtacaatgagg

SEQ ID NO: 227503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacggcttcctagggacatgcctgactgct

SEQ ID NO: 227504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacggggtagtgcgtataagggaggcgtag

SEQ ID NO: 227505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacggtcccatgtcatatatggaaataaga

SEQ ID NO: 227506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacggttgaaggtagctgggggctactgat

SEQ ID NO: 227507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgtgccgcagatctggtgaccccgagcc

SEQ ID NO: 227508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgttagatactggcacataaggcgttac

SEQ ID NO: 227509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactactcctgggaccagtgtaaccagctt

SEQ ID NO: 227510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactagagcactaacacgatggattttcgg

SEQ ID NO: 227511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactcccaaaggacccgcggcgtgtgcgct

SEQ ID NO: 227512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactctgcttgccctaaagttttcacgctt

SEQ ID NO: 227513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacttatctacagtaacttgatctccacgc

SEQ ID NO: 227514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacttcgaaaattctggtcgcctttggcta

SEQ ID NO: 227515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacttggcggcaaacgccaggaatgaacac

SEQ ID NO: 227516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacttgttacttaacgcgtccccaattgct

SEQ ID NO: 227517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacttttctatggtaaactctactggcatg

SEQ ID NO: 227518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagaaactcatgtgtggcggattggcgagt

SEQ ID NO: 227519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagacccatagggccccatccgcgtattct

SEQ ID NO: 227520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagaggggagaggagaccggacacgccacc

SEQ ID NO: 227521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagagtctgggatatttgttcgtcgtcgaa

SEQ ID NO: 227522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcaaagtgttcaacatgcgcgatgactc

SEQ ID NO: 227523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcaagagcctcgcatatggcactgtgca

SEQ ID NO: 227524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagctcggttcggtggctatggacagcacg

SEQ ID NO: 227525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagctgggtaattcaagtgcacttttcatc

SEQ ID NO: 227526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcttggcgacgtaggattgtgggttgca

SEQ ID NO: 227527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaggctaaacttcaaaccccatgtaaatgc

SEQ ID NO: 227528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaggctatatttgggagacagctgtgagcc

SEQ ID NO: 227529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaggctgtagtgttttcggtagagctccgt

SEQ ID NO: 227530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaggtgaaggttgcgaagttcttcaatccg

SEQ ID NO: 227531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagtaacggtactaaggtcgacagtgcgtg

SEQ ID NO: 227532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagtaagctgtggcatgagacagttgtgct

SEQ ID NO: 227533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagtaagggattgaacacgaagtctggtgg

SEQ ID NO: 227534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagtcattcgtgttctatttagtgcaacgc

SEQ ID NO: 227535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagtttcatgccttttatttctaactctcg

SEQ ID NO: 227536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgataatcgcgcgcgctcaccgggctgcatt

SEQ ID NO: 227537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatagcgtgttagggtcgacataaatatac

SEQ ID NO: 227538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatagtacgtctgtgttgttgtttgtagca

SEQ ID NO: 227539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatattgacggaccgaagacgaacatcgac

SEQ ID NO: 227540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatcagtctgttcttggtggtaacctagct

SEQ ID NO: 227541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatcctatttatccccacgctgagaacttt

SEQ ID NO: 227542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatcgttggtcgcgttccgtatatgcaatc

SEQ ID NO: 227543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatctgagtctcgatacatagcagctgtaa

SEQ ID NO: 227544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatcttacttttccgccactagcacgtctc

SEQ ID NO: 227545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatgatgttgtcggagaacagtgctgccgt

SEQ ID NO: 227546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatggaggagtacacgtgatccttgggttc

SEQ ID NO: 227547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatggcgacttaacattcttagcatggcac

SEQ ID NO: 227548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatggcgtagaggtaagtttattacgcatt

SEQ ID NO: 227549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatgtcttgtcgtcccaaattatcttctat

SEQ ID NO: 227550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatgttcacaaacaaacagctgttctctag

SEQ ID NO: 227551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgattcttccgcttggtcagccctgctagga

SEQ ID NO: 227552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgattggacgaggactaagctgatggttaat

SEQ ID NO: 227553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgattggcaagtgctgccgtatatgtacccg

SEQ ID NO: 227554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgattttcctttgattggtaacgactcgcca

SEQ ID NO: 227555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaaaaacttaaggcacgtaccatttgcta

SEQ ID NO: 227556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaaagatatgggtctgcaagccgtgacaa

SEQ ID NO: 227557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaaaggctaatgttcctgcaacatgtagc

SEQ ID NO: 227558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaagttgtgcgtgatacctagcccccctc

SEQ ID NO: 227559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaatgactttttgaacgccgacgcagcca

SEQ ID NO: 227560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcacaatcctacgttatgtcacattatggc

SEQ ID NO: 227561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcacaccattcgtaggcttcctgaggtttg

SEQ ID NO: 227562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaccacatctaccctgactatttaactat

SEQ ID NO: 227563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaccttatgaattcggtagtacgctcccg

SEQ ID NO: 227564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcactacttccaaattactggatatactta

SEQ ID NO: 227565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcactgagttaaggaattaattgcgcagta

SEQ ID NO: 227566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcagagcacgtccatgactcttctcgtgca

SEQ ID NO: 227567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcagcatgcgcttaccggtttagggaacct

SEQ ID NO: 227568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcagcgtgagacatgttatgacgcggaccg

SEQ ID NO: 227569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcagctgtatcggaagaataaccgagcggt

SEQ ID NO: 227570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcatgtttcctacagagcaggatcgtgttg

SEQ ID NO: 227571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcattagcccacgattatattaccttggtg

SEQ ID NO: 227572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcattgagcggaccatcaccggtttctgtg

SEQ ID NO: 227573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccactctttcgcgcaacctggctcgctcc

SEQ ID NO: 227574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccagacgcttgtttgtatgtaattctccg

SEQ ID NO: 227575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccagggaaccatcggccattcatggcttt

SEQ ID NO: 227576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccccttcccgactaacaactatgaatcgg

SEQ ID NO: 227577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcccggcatggtctttggttatgcgtacca

SEQ ID NO: 227578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccctatgggccctactttcttgatggagc

SEQ ID NO: 227579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccctgtcccgggtatgaccggttcctact

SEQ ID NO: 227580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccgattgtaggtaactttttccttggctc

SEQ ID NO: 227581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccgcattgagtcgagtctaccgtatctca

SEQ ID NO: 227582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccgttcaggtgcgtggggtaccgtacaga

SEQ ID NO: 227583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcctaacgaactctatcctttcattattct

SEQ ID NO: 227584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgacatcagtgcctccgcccttcctggta

SEQ ID NO: 227585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgagacggagtttttcgatgggtgattga

SEQ ID NO: 227586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgagagacggtgatccgtgaatgttatgc

SEQ ID NO: 227587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgaggcgggcgacagtttataggcgcgga

SEQ ID NO: 227588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcaccgccatcactggttaatattctgg

SEQ ID NO: 227589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcagtccgatagtcgtgtattggccacg

SEQ ID NO: 227590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcgcttaaacacgtaaagctcggtacac

SEQ ID NO: 227591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcggttgaattgggagcgcagttatgtc

SEQ ID NO: 227592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgctcttcttatgacctgcatgtataggt

SEQ ID NO: 227593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggaagtcctctgatgccatgggctgtgt

SEQ ID NO: 227594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggcgtgggcttgaaaagccttgcagttc

SEQ ID NO: 227595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgggtttgcaggtctcgtattgcgataag

SEQ ID NO: 227596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggttgcattgttattccctccctttctc

SEQ ID NO: 227597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggttgttctggatgactccattcgatgt

SEQ ID NO: 227598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgtaatagactcaatatttttgttcccgc

SEQ ID NO: 227599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgtgcaaagggaagcgagaattggtgtcg

SEQ ID NO: 227600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgttgcatcgagctctgcctatctaagtt

SEQ ID NO: 227601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctaacgatcaagatctgctagtggataaa

SEQ ID NO: 227602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctaatctttcacttccggtgcttcccccc

SEQ ID NO: 227603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctcagacatccaatgtaaggcgacgcgct

SEQ ID NO: 227604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctccacggcgatgtgtgtggtatgtgggt

SEQ ID NO: 227605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctcctagtttattgccgcgagcgtgggaa

SEQ ID NO: 227606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctcctcttcactttcggcttctaactgca

SEQ ID NO: 227607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctcggacctatgccgatggagcctgagct

SEQ ID NO: 227608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctctgctcactgctctatcatcgaatgtg

SEQ ID NO: 227609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctcttgactggagtttgagcaattaacgg

SEQ ID NO: 227610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgcatctacaagtagacagtttcgggcc

SEQ ID NO: 227611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctggcttcgtgcgttattgtgagattgcg

SEQ ID NO: 227612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgtcaaatgttagttaaccatgcatggc

SEQ ID NO: 227613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgtcgcactgatgcatgtgtgttgcaat

SEQ ID NO: 227614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgtgatagacgagactttcactctgaat

SEQ ID NO: 227615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcttagatctccaccttatgctttgcatag

SEQ ID NO: 227616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaaaatgcacgacaggtgctgggttggct

SEQ ID NO: 227617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaacagcgcctatgtgatgacttggggac

SEQ ID NO: 227618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaagaagattttaggcgttaaaagtgaat

SEQ ID NO: 227619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaagctttctgagatcctatggtaaaagc

SEQ ID NO: 227620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaataggtacgttcaactagatccccatg

SEQ ID NO: 227621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaatcggttatacagttcgtaaaacttgc

SEQ ID NO: 227622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaatgcaagctcagtcattacatatcatt

SEQ ID NO: 227623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacagaaacttctctggcgtttcacgctt

SEQ ID NO: 227624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaccacgagaaagtcgttaagattcatcc

SEQ ID NO: 227625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacctcaggagcatgttgattttccactc

SEQ ID NO: 227626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacttttacgactagctgggtcctactct

SEQ ID NO: 227627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagcctgtacttagtccgcaggaggtcta

SEQ ID NO: 227628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagctgcttgagagctctcgcggaaacgt

SEQ ID NO: 227629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaggtggtcgaaaatcggatctgcgagct

SEQ ID NO: 227630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggatgcctcgacacatcatggattgtccgt

SEQ ID NO: 227631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggattttaccgttggactagactgacagtc

SEQ ID NO: 227632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcacaaagtgtgagcgctccgatcgcacc

SEQ ID NO: 227633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcacaccagaatttgaatatcgcagaacg

SEQ ID NO: 227634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcacgataggtgagaagcgaccacttggt

SEQ ID NO: 227635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcagatgagtgcttcaaatggggaatgct

SEQ ID NO: 227636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcaggagagccgatcccctccttcaggtt

SEQ ID NO: 227637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcatagtcatacatgcatacgggtatgta

SEQ ID NO: 227638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcatgccccgtcacaaccttcgggggtag

SEQ ID NO: 227639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccacacactttgattttctcacgatcgc

SEQ ID NO: 227640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccactgggagtgatgggtacagctcgaa

SEQ ID NO: 227641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccatgcccaacgataaatcgtgggtgct

SEQ ID NO: 227642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcccgttgcctgctttaagttgtcattct

SEQ ID NO: 227643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccttcgtactattctgaccaaacacgtg

SEQ ID NO: 227644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccttgtgggacaaaacaggtattcgtgg

SEQ ID NO: 227645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgaaaatgggtactgccatcgttcccac

SEQ ID NO: 227646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgaaggcgcaaacgtgacggcttcactt

SEQ ID NO: 227647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgacgatctgcgttagtgtgactcttaa

SEQ ID NO: 227648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgtggtgaattgtccgacgctcgaaact

SEQ ID NO: 227649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctaatatcccagaggggggtatccgcct

SEQ ID NO: 227650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctaatcctgtgagcccgcattagctcgt

SEQ ID NO: 227651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctcaacgcaaggcgcgcttgcgatgcac

SEQ ID NO: 227652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctgggccggacagacgacacatggcgtg

SEQ ID NO: 227653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcttacacgtatacccgccgaaagaggct

SEQ ID NO: 227654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctttcgtggatgaagcgctattctccct

SEQ ID NO: 227655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggaattgggtcttctcggtgggttaccca

SEQ ID NO: 227656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggagtgttctacatcgtcaagtttcatcg

SEQ ID NO: 227657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggattcagaggcggctctcataggtccgt

SEQ ID NO: 227658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcaacctggaatcatccagaagttgctg

SEQ ID NO: 227659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcggtgcagctaacccccggatgactaa

SEQ ID NO: 227660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggctatagcgtgcctcgctattcggcata

SEQ ID NO: 227661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggctatgacgagtatatgcttattggcgc

SEQ ID NO: 227662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggaatttgatataagcgcgtgacagtgc

SEQ ID NO: 227663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggggtagttgtctgaatggtccaatatc

SEQ ID NO: 227664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtaagaagttacggtcggcggatgcaac

SEQ ID NO: 227665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtcacgattagacatgcgttcggcttca

SEQ ID NO: 227666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtcattttaatccgggtctttggtgagg

SEQ ID NO: 227667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtctcacggaactcagaatctccggtat

SEQ ID NO: 227668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtctgtttattacactcgatggcacgcc

SEQ ID NO: 227669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtgccaggcggactaggccatgtccatc

SEQ ID NO: 227670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtgccggatttcctcagtccttgcccac

SEQ ID NO: 227671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtttagaattagactctgcgagtcgact

SEQ ID NO: 227672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtaaactaagcacgctcgtttgacgattc

SEQ ID NO: 227673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtaacaataaagtttcttacgcggatatg

SEQ ID NO: 227674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtacagactgcgcttcaatttgctgtgga

SEQ ID NO: 227675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtaggaccgtaaagcaaacggcgatccaa

SEQ ID NO: 227676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtagtacaaggtgtgtgtgcctcagcgtt

SEQ ID NO: 227677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtatagtcgactatctgttagctccgttt

SEQ ID NO: 227678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtattactttatcgtggttaaatacttat

SEQ ID NO: 227679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtattgaagctagcgacgactccccctta

SEQ ID NO: 227680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtcatggctgctctcgctccggtaaccta

SEQ ID NO: 227681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtcggtacgcttgctaacaccgtgctcca

SEQ ID NO: 227682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtctattaggaatttctgcatttgatggg

SEQ ID NO: 227683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgaaactccacgttagtgcgtgcggtct

SEQ ID NO: 227684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgagctccctcaggcaatgtgttatcat

SEQ ID NO: 227685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgcgagactgcggggcgaccaccctgag

SEQ ID NO: 227686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgctgttcgagctgcgagtgaggcacgc

SEQ ID NO: 227687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgcttaatgagggacgagtgacgttgtc

SEQ ID NO: 227688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgtactttggtaggctcggtgtaatgct

SEQ ID NO: 227689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgtttgtgcaggcgacgtacaggtatga

SEQ ID NO: 227690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggttccttcggattcgtgcgcagatcttga

SEQ ID NO: 227691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggttgaatacgtgtgacgatttcgctacgc

SEQ ID NO: 227692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtttcatgcataaatttgcgcggataaac

SEQ ID NO: 227693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtttgacaaaatctaagttgtgattggta

SEQ ID NO: 227694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtttgattcaatcagaacgcattttgccc

SEQ ID NO: 227695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtacagccagacctggaccgtctcgcaact

SEQ ID NO: 227696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtacagcgtaaaaagcatgccccttttgcg

SEQ ID NO: 227697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtacccgctgcatgtagtcggtccagtagc

SEQ ID NO: 227698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtacgaaccactctcccggcgttaatacgg

SEQ ID NO: 227699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtacgcaagagtcccacaccgtaatcaagt

SEQ ID NO: 227700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtacggcgctttcaatgtagggccttcctt

SEQ ID NO: 227701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtagacttctctgacagggctcttgtaaag

SEQ ID NO: 227702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtagcggtggtgcagttattgggccatagc

SEQ ID NO: 227703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtagggattggggtatatgatcacggtcat

SEQ ID NO: 227704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtatgcgctcttcttgcctccaatagtggg

SEQ ID NO: 227705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcacctcaagtggcagccaggctaggccg

SEQ ID NO: 227706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcacggtgagttagatacggcccacacga

SEQ ID NO: 227707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcctagtcgtgtgctactggatttccgcc

SEQ ID NO: 227708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcggcaatgtacgctcatgttaggtgttc

SEQ ID NO: 227709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtctctcaacgccctctcactttgaagctc

SEQ ID NO: 227710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtctgcacttcagtattggatagcgcgtcg

SEQ ID NO: 227711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtctgcggatttccatttgcattttgggga

SEQ ID NO: 227712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcttccataagggcggaattgagtgaaag

SEQ ID NO: 227713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgacaacctaaagggctactctggtgatg

SEQ ID NO: 227714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgacataggcattagtttctcaaccctca

SEQ ID NO: 227715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgacgcggtggaccgagaacttagacggt

SEQ ID NO: 227716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgacttaattaatccacacacagtggttg

SEQ ID NO: 227717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgcaaacggagatagatagttcccgatac

SEQ ID NO: 227718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgcaatcatggttccccagcgttctatgt

SEQ ID NO: 227719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgccaggtgggtttgaacttcagtcacct

SEQ ID NO: 227720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgcgacgttgttaagggacctagcacgtt

SEQ ID NO: 227721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgcgatccgcgtgtcgcattgcggttcca

SEQ ID NO: 227722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgcgcagtagcgaggctggtacgtaaagg

SEQ ID NO: 227723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgctattatcccgtcctatggctttcaat

SEQ ID NO: 227724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgcttcggcatatcccaaataggccggtt

SEQ ID NO: 227725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggaccttggaaccgtttgttaatcggtg

SEQ ID NO: 227726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggccatcgctgcgaatgtgcatgggtaa

SEQ ID NO: 227727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggccttgagatctagtgaccagtgtcca

SEQ ID NO: 227728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgggcagcaaaacccttcctgaagtcatc

SEQ ID NO: 227729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgtggtatgtgctactgttcacgggacac

SEQ ID NO: 227730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgttcaaagaggacaataccacccgcgag

SEQ ID NO: 227731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgttctctgaaatctcaacagcctggggg

SEQ ID NO: 227732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttaagacacagaatagcatctgttgtgct

SEQ ID NO: 227733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttaatgtccccatgtggtacgatgtacga

SEQ ID NO: 227734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttagagcggactaaatcttccaacgaatc

SEQ ID NO: 227735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttagagttatcctatattcggttacaacg

SEQ ID NO: 227736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttagcgggctacctacctactgtagttaa

SEQ ID NO: 227737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttcattgatcccgttcctaaagtctagcc

SEQ ID NO: 227738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttcttgaaactgtctcccaagtataggcc

SEQ ID NO: 227739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttgatcgttaagtgaattagcaatccggg

SEQ ID NO: 227740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttgccgcagaacgttagtgctattcagtc

SEQ ID NO: 227741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttgtcgaatagacatggacgagccaggtg

SEQ ID NO: 227742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtttccggcaaagagctaagggtattctgt

SEQ ID NO: 227743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtttgtagatttactattttactggttccg

SEQ ID NO: 227744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttttcgttgatccgacttggagactccgg

SEQ ID NO: 227745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaaatccccgggggagccttgcaaccattg

SEQ ID NO: 227746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaacatgcttttactccatgactgctgtga

SEQ ID NO: 227747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaaccagggaataatgtaagaacaagtccg

SEQ ID NO: 227748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaaccgatgatcaatggggagtggactgtc

SEQ ID NO: 227749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaaccgtgtgtctacccgctctgtattata

SEQ ID NO: 227750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaactgccctttggcttgaagatgccgggt

SEQ ID NO: 227751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaacttctgaggtgcgagtactttggcaaa

SEQ ID NO: 227752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaagattattgagactgcaagctcccaagg

SEQ ID NO: 227753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaagcaggtagtcccatgggtaagccagcg

SEQ ID NO: 227754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaaggctcatggttaagattatgtgcggtt

SEQ ID NO: 227755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaaggggccggcagctgacaacaccagccg

SEQ ID NO: 227756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaaggtttggatcgtgcaagatggtagggg

SEQ ID NO: 227757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaagtttgagggtgaggtctccggcctaag

SEQ ID NO: 227758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaatatttacctgttagtgttataggattt

SEQ ID NO: 227759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaatccggaccaagctaggacaagccagtt

SEQ ID NO: 227760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaatctagtgtccattgacaggccatgaca

SEQ ID NO: 227761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaatgaccacgatttcacgagttcccgggg

SEQ ID NO: 227762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaatgtgtattttacagtttaattaatgtc

SEQ ID NO: 227763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaattctaatgacacgctatatcacaaatg

SEQ ID NO: 227764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaattggaattatctgtttatacatctatg

SEQ ID NO: 227765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaattgtgggtaacggttatttacagaatc

SEQ ID NO: 227766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacaaaaacgtactgccaaacatgtgcttc

SEQ ID NO: 227767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacaattcaccaacccttatacaaaccctg

SEQ ID NO: 227768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacaattttgatctggggtgttacgttgct

SEQ ID NO: 227769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacacggcttgtgcgttacgagaggtttac

SEQ ID NO: 227770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacagttcggtgctaaagtatctgtagttt

SEQ ID NO: 227771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaccagggggaggatggtcttagatcgctg

SEQ ID NO: 227772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaccgttccgctcggtgtcctagctagcct

SEQ ID NO: 227773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaccttctcatacgtacggtcgacgtgcgc

SEQ ID NO: 227774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacgatgagcgcttctcgttctcaaggtgg

SEQ ID NO: 227775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacgggtagtactgtttatcaatcacaagc

SEQ ID NO: 227776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacggttacccgaattttcgcaggacttgt

SEQ ID NO: 227777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacgtatagcccatgagcattgttgcgtag

SEQ ID NO: 227778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacgtgcatagccggtgtacatagagattg

SEQ ID NO: 227779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacgtgtatatcgctttattggcacgagtc

SEQ ID NO: 227780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacgtttgtgtatgattgtgatgtgctgtt

SEQ ID NO: 227781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctactacctcatatctgatgactagccgcgc

SEQ ID NO: 227782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctactatcactagagggggccaggaatgatt

SEQ ID NO: 227783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctactgacggacagattggctcttcggggtg

SEQ ID NO: 227784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctactgccatggaaactcgtgttttgtttca

SEQ ID NO: 227785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctactgtacttgggagctaagcctcgccgtt

SEQ ID NO: 227786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacttattcgtgctacaattgccgcgtttg

SEQ ID NO: 227787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagaattttactccgtgaatgcaacttcct

SEQ ID NO: 227788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagccaaagaaattaaggaaaggataatcc

SEQ ID NO: 227789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagccatggcagcctgtcgtcacaacatcg

SEQ ID NO: 227790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagctattaccattgaacagagatcaccca

SEQ ID NO: 227791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagctgcgaccgacgcaattcactattttt

SEQ ID NO: 227792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaggactgaccggtttccgttttcattctt

SEQ ID NO: 227793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaggatgttcttttcatagtacatgtcttg

SEQ ID NO: 227794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaggcaactccgcgttaaccgttgcagaag

SEQ ID NO: 227795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaggcactttttgactttttgtcttatcgg

SEQ ID NO: 227796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagggacagtttggtcatcgatccctaagg

SEQ ID NO: 227797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagggtcagcaggttctcagcgccgccacc

SEQ ID NO: 227798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagggttgcccaacgagactttgcttgtct

SEQ ID NO: 227799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagggttttgcatggttcgcctcgtttttg

SEQ ID NO: 227800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaggtccctactttttatgcacggtgtttc

SEQ ID NO: 227801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagtgctagctcgggtcagcaagaggtagc

SEQ ID NO: 227802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagtggggggactcgaggttggccggactt

SEQ ID NO: 227803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagttctcttcagtggccctaggacgagcc

SEQ ID NO: 227804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagttgcaagatcgcggtggctcgggccgg

SEQ ID NO: 227805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctataattgagatggtctcgtcgacaggaag

SEQ ID NO: 227806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatactgctaactgggacgttgtctagctc

SEQ ID NO: 227807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctataggtgctggtttgcgatgtggtcagta

SEQ ID NO: 227808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatatgcaattgttaagtgacgacgaagtg

SEQ ID NO: 227809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatattgatgagggttatggagtctggctg

SEQ ID NO: 227810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatcagtcagttactggtgtagaatggcta

SEQ ID NO: 227811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatcattagtttctggaagttcccgcttga

SEQ ID NO: 227812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatccctgttctgtcgctagatccgattgt

SEQ ID NO: 227813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatccgagtcctgttcttcttctggtcgaa

SEQ ID NO: 227814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatcctatgccctctgctctatcttgacct

SEQ ID NO: 227815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatcgcctctttacattcgcgggttgtcgg

SEQ ID NO: 227816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatcgcttatggttttttctgttatagtgg

SEQ ID NO: 227817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatcgggttcgatgcggctcgaaggtggta

SEQ ID NO: 227818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatgactgctacgctatgttaccagagagc

SEQ ID NO: 227819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatgatgcttgtttcaaatttgtctatgtg

SEQ ID NO: 227820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatgcgatgggagcttcactactagcgcgt

SEQ ID NO: 227821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatggagtacaatctcataccggtactaac

SEQ ID NO: 227822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatggatctatacctgttcgagcttacgta

SEQ ID NO: 227823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatgggtgccaggaacgcgattctctctta

SEQ ID NO: 227824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatggtttagcgaccggattttacaaaata

SEQ ID NO: 227825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatgtcattattttcgactagtgctggtta

SEQ ID NO: 227826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctattcatgcaaatcggccatcaggtatacg

SEQ ID NO: 227827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctattcgaacgaggcttcgcacatcaggttg

SEQ ID NO: 227828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctattgtggccggtgaaggttgggtttcgct

SEQ ID NO: 227829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatttctaggcgatgcccagttgcctttaa

SEQ ID NO: 227830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatttttctgaagtcccaaagacgagaggc

SEQ ID NO: 227831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcaagcttctcaaacttagaggtcaccggg

SEQ ID NO: 227832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcaagtgggtaaatggggtaacgcagatag

SEQ ID NO: 227833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcaatctaacacgactttcaatgctcatac

SEQ ID NO: 227834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcaccgactactagctgatagggtgttttc

SEQ ID NO: 227835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcacgagtccagaatgtctgtggccattga

SEQ ID NO: 227836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcacggatacaaacaatgtcagaccggtgg

SEQ ID NO: 227837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcagacagttcttacgcggatcctggtatt

SEQ ID NO: 227838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcagactctacttcttacactatttttagg

SEQ ID NO: 227839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcagataatatgcgatgtagcacgtcagtt

SEQ ID NO: 227840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcagcagcatcttgtcagagtgagtcctca

SEQ ID NO: 227841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcagctgttggcgattgtctttacaagcaa

SEQ ID NO: 227842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcaggggacgagcgagggcattgtgcctgt

SEQ ID NO: 227843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcagtcggtctatcaggcaatatcagtccc

SEQ ID NO: 227844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcagttccgcctgggttatgcctcgcccat

SEQ ID NO: 227845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcatacaaaaaaagcattcgcggcattggg

SEQ ID NO: 227846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcatagggatacaccgcatcaagctctatc

SEQ ID NO: 227847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcatattcatacagccaatgaatcggtgtc

SEQ ID NO: 227848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcatcttggccggttattaccctattgtat

SEQ ID NO: 227849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcattagtatgccacgttggttaaatcgcg

SEQ ID NO: 227850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcattcttggataaaactttcatggtcagc

SEQ ID NO: 227851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcattggagaactgcacacttccgcaactg

SEQ ID NO: 227852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcatttccatcacgggttttagtccagttt

SEQ ID NO: 227853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccagactatagaccttgtgtcggactctc

SEQ ID NO: 227854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccagtcgtgtatcacgtgcgctattcacg

SEQ ID NO: 227855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccataatgcttttgttattgaccattctc

SEQ ID NO: 227856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccatttctttgatgcggccctggtcctaa

SEQ ID NO: 227857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcccacagtgggcgggagtaaaattgcttt

SEQ ID NO: 227858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcccacgacttcgttctgactgtcccattc

SEQ ID NO: 227859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcccactatcacctgtgtactgcataacgc

SEQ ID NO: 227860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccccattgcacggacgctgctgctggttt

SEQ ID NO: 227861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcccgagtgcgtgtatttcgtcccggtggt

SEQ ID NO: 227862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccctttgcgatcttctatcattaactagc

SEQ ID NO: 227863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccgccactcaatttttgtaaggctaagag

SEQ ID NO: 227864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccggaattcccagatgcgattgtcggaag

SEQ ID NO: 227865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccgtcggttatccgatcacgcccaagtgc

SEQ ID NO: 227866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccgtgccttggtcatcagactgatctctt

SEQ ID NO: 227867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcctctccctgtgcatgatcttaattggca

SEQ ID NO: 227868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcctgacatagaagctaagattcgtttcac

SEQ ID NO: 227869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcctgatgatacacctcaactggctcactc

SEQ ID NO: 227870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcctgccagcagtacctgtaattgtgttat

SEQ ID NO: 227871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgaactgttagcctcaggtatctatccgc

SEQ ID NO: 227872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgacagcacgcgctatggcgagattaccg

SEQ ID NO: 227873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgagcatacctcaattgagtttcccgagg

SEQ ID NO: 227874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgagggatttcccgaggtggaaaagtgtc

SEQ ID NO: 227875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgattcatccgactgttcgactccatgtt

SEQ ID NO: 227876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgcaaagctataattcccaggatccggtt

SEQ ID NO: 227877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgcacaatcgtgatctctttcgatctggg

SEQ ID NO: 227878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgcgtcgtgcggggtgctctatcatttgt

SEQ ID NO: 227879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgctgccagattcctggggtcgtgcacgt

SEQ ID NO: 227880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcggaatccgatttttaatgattaccctct

SEQ ID NO: 227881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcggagcttgtgtgctttcatgtggaatta

SEQ ID NO: 227882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcggataataccttgggattcttacgctac

SEQ ID NO: 227883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcggccctgtcttgcggctttggtcacctt

SEQ ID NO: 227884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcggccgtcccgacgaaattgtccgcctca

SEQ ID NO: 227885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgggggaaaaatgttctctgtactggtga

SEQ ID NO: 227886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgggttcataatgggcagttggtgaattt

SEQ ID NO: 227887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcggtaaaacaccggcggttccctcgcttg

SEQ ID NO: 227888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgtcgacagtccggttctctcggtacatg

SEQ ID NO: 227889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgtgataacgtgttgttttagatcgggtt

SEQ ID NO: 227890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgtgggtgggcccatttttgtttgagagc

SEQ ID NO: 227891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgtggtgaagccaatggccattcctgccc

SEQ ID NO: 227892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgtgttaaggaggtagaagttctgcatac

SEQ ID NO: 227893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgttccaaagcattatcataacgcagata

SEQ ID NO: 227894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgttgcaattcacgccctatttaaattag

SEQ ID NO: 227895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctaagcccagcacaatgtcctccgattgc

SEQ ID NO: 227896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctacataacagccgtgactgcaagcatgt

SEQ ID NO: 227897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctatgtactgtttacgtctgttcatatgc

SEQ ID NO: 227898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctattagttcaaccaccatttttcttttc

SEQ ID NO: 227899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctattgccgagttcgaattccagccagac

SEQ ID NO: 227900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctcatttaaaaacgggctacccctccgca

SEQ ID NO: 227901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctccggtgtttctattaactgccggattt

SEQ ID NO: 227902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctcgccatttaatgttagcgttatctgtt

SEQ ID NO: 227903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctcgcgaaggggcgactggactttatctg

SEQ ID NO: 227904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctcgctccatgttcaatctatggatgttg

SEQ ID NO: 227905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctgactccaggcacaatactgcaggttct

SEQ ID NO: 227906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctgactgttttggaactcggatggggatt

SEQ ID NO: 227907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctgaggtcccggggggctgcagacggtgt

SEQ ID NO: 227908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctgagtggaaacccgatgcaccccaaatt

SEQ ID NO: 227909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctgcgtgcatcattgtggtggtagctcgt

SEQ ID NO: 227910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctgctcggcaccctcaccacggtaaccac

SEQ ID NO: 227911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctgctcggcctacctataatccggcctcg

SEQ ID NO: 227912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctggccagcttgaacaagttgtagtcgcc

SEQ ID NO: 227913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctgttcgcgcaattaaagcgtgttcccac

SEQ ID NO: 227914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctgttttatgcaccgggactggttgcgtc

SEQ ID NO: 227915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcttatccgttagtgcgaagtggggtccga

SEQ ID NO: 227916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcttattattgaggtgcgattctatcctta

SEQ ID NO: 227917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcttgcgttatccgcatttttgctatgtac

SEQ ID NO: 227918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcttggaatgttcttcccgcccagcttgat

SEQ ID NO: 227919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcttgtaagatcgatatcctactgacgtaa

SEQ ID NO: 227920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctttcgattgcggtgacagaaacaggata

SEQ ID NO: 227921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctttgccgtacttcaagctgtgcatacca

SEQ ID NO: 227922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctttgcggtcacacatgtccagatcgtgt

SEQ ID NO: 227923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctttgtacggaatgtctcgtgcaataaag

SEQ ID NO: 227924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctttgtggagagccgaccttggtggcgct

SEQ ID NO: 227925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgaaatgataaatcgcactggcgatcttta

SEQ ID NO: 227926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgaacgagtagcttaaactagccatcgggt

SEQ ID NO: 227927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgaagtccgttaggggcctttattctcggg

SEQ ID NO: 227928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgaagtgtagcgcgcccaacggttaggact

SEQ ID NO: 227929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgaagtttagtcatgcaattttaccgtacc

SEQ ID NO: 227930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgaagtttggttgggatactactatttcta

SEQ ID NO: 227931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgacattacgtttaaggaggttatctttct

SEQ ID NO: 227932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgaccgggattattttaccacttgacgggc

SEQ ID NO: 227933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgacgtatgtgatttaggcatgttgggaaa

SEQ ID NO: 227934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgactatagatatttcactgtgtatcttta

SEQ ID NO: 227935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgagaactacttttctatacgcttttccac

SEQ ID NO: 227936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgagagcatgcagttgtgactaacccaagt

SEQ ID NO: 227937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgagatgggctcattgaagggtaaggagtg

SEQ ID NO: 227938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgagcccaactagtatagaactttctgaat

SEQ ID NO: 227939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgagcccgtatcgtacgttgttccagctgc

SEQ ID NO: 227940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgagttcggtcaggggcgcaaagcctaacg

SEQ ID NO: 227941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgatagaattcgtctactccctctggcacg

SEQ ID NO: 227942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgatcgagttcaagcgaatttctcctaact

SEQ ID NO: 227943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgatgatgacccaatgagcaagaaaactga

SEQ ID NO: 227944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgatgctagataaggctttggctcatccga

SEQ ID NO: 227945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgattcatatggttttaagctgagtaatcg

SEQ ID NO: 227946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgattccatgcaacgtagtagatggccgga

SEQ ID NO: 227947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcaagtattacccatatgtacccctaccc

SEQ ID NO: 227948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcacagaaaatcttgtagttaaactacaa

SEQ ID NO: 227949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcaggtgttattatcaatccctcccactg

SEQ ID NO: 227950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcataatagtcgtatgtcccatatctggc

SEQ ID NO: 227951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcatgttcataagcacggatgcgttcggg

SEQ ID NO: 227952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgccccagcacagttgaactttggatcccc

SEQ ID NO: 227953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcccctttatcgttcacgctcataggtgg

SEQ ID NO: 227954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcccgtccggtctcccacatgttacctaa

SEQ ID NO: 227955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgccgagatggcgttttttgtacccctggt

SEQ ID NO: 227956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgccggccgtagctgagttgcacggtttgt

SEQ ID NO: 227957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcgaacaataaattttgttcttggtcagc

SEQ ID NO: 227958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcgaggagtcctctcaagcgaccgcgatt

SEQ ID NO: 227959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcgcacgagagcttgattctgccggctgc

SEQ ID NO: 227960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcggtaatacttctgtaactcttcttcaa

SEQ ID NO: 227961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcgtatgaaaaggttccatggggcagcac

SEQ ID NO: 227962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcgtcattttccatcttgcatacgtgggc

SEQ ID NO: 227963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcgttcaaatgatcgaccctattctacgg

SEQ ID NO: 227964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcgttttcgcagtatgtggtccatagtag

SEQ ID NO: 227965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgctaaagggcatactgtagtgtttcacgg

SEQ ID NO: 227966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgctatcccggtaacatgtagagtaagctt

SEQ ID NO: 227967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgctcctagcgagcttaaaaaaatgtctac

SEQ ID NO: 227968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgctggtgccgttggatctcgtctctttac

SEQ ID NO: 227969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgctgttaggtgttgaggtagctaccggga

SEQ ID NO: 227970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcttgtggttacggaagcctaggcacgtg

SEQ ID NO: 227971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgctttattgtatacaacccgatatttagg

SEQ ID NO: 227972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggaaactcgctaggggttgtaccggtgtg

SEQ ID NO: 227973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggaaagccggattccacgggctgcccgtt

SEQ ID NO: 227974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggaaccgtttgggaggaactggctgtgtg

SEQ ID NO: 227975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggaatgcggttctaaactaggttagtgtt

SEQ ID NO: 227976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggacggagaagggggtgcactttagtcgg

SEQ ID NO: 227977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggactttgttagataaaatgcggcggtcc

SEQ ID NO: 227978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggagcggcaagtagttgatgacccgtttc

SEQ ID NO: 227979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggaggttctgtgtttctacggggaagcat

SEQ ID NO: 227980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggatccctctatggaacagttgcttgatt

SEQ ID NO: 227981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggatgtttaactaatgacatgctggcgta

SEQ ID NO: 227982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggcccggcatcatatgatatatttcgttc

SEQ ID NO: 227983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggcctggttgaatacgcgacgtttttagg

SEQ ID NO: 227984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggcgaatgtgcacatttcagtggcacgtc

SEQ ID NO: 227985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggcggcccattaccttaggatcgctttat

SEQ ID NO: 227986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggcggtggcggtattgtctcccatctggt

SEQ ID NO: 227987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggctagttgttgaaccgaccgaactgttg

SEQ ID NO: 227988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggctccttatggcttgtatcggaccaaga

SEQ ID NO: 227989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggctggggcagtggagcgcagggatcccc

SEQ ID NO: 227990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggaacgcatcacccgcgttttcttcctc

SEQ ID NO: 227991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggaggtgacgcacaacatgtttcttctt

SEQ ID NO: 227992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggcatgacgatggatcgcccctcagcgg

SEQ ID NO: 227993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggctttaggttgttggcgatctaaggtc

SEQ ID NO: 227994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggcttttatcgttggggtgacataggcg

SEQ ID NO: 227995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggggcgatgctttgagtcggcgttagtt

SEQ ID NO: 227996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggttggaatttacgggccctgatttact

SEQ ID NO: 227997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggtacgctgcttcctggcaatgctcggtt

SEQ ID NO: 227998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggtgctacggcgctaacggtccaaagttt

SEQ ID NO: 227999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggttcggtcatagaaaggacagccatttc

SEQ ID NO: 228000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtagggtccgctggactaattaatttcac

SEQ ID NO: 228001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtatattcgcaattatcgtttataactga

SEQ ID NO: 228002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtatgttgtcattgtcacgtcgaagccac

SEQ ID NO: 228003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtcagtcccgagcgctccttaaacgtttg

SEQ ID NO: 228004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtccctcttatgtgcgttgctgcaattcc

SEQ ID NO: 228005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtccggcaatcggcccgggaggttctgtc

SEQ ID NO: 228006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtccttcggtgaatattaggttccccagt

SEQ ID NO: 228007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtcgaatctttacagacggcatcaagatg

SEQ ID NO: 228008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtcggtgacatctaatgtgacagacttcc

SEQ ID NO: 228009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtctgcgcgcgtacaaacaggaagaggtt

SEQ ID NO: 228010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtcttcggcatactactatagttcctggc

SEQ ID NO: 228011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtcttgcgtaaatggatatgagtccgcta

SEQ ID NO: 228012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtgctggtgtgatatatttattccgccta

SEQ ID NO: 228013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtgctgtgaatgacaattatgtggctcgt

SEQ ID NO: 228014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtggatgatcttttgtccggaagaggggt

SEQ ID NO: 228015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtgggaagtaagcagaaaacagagaaaga

SEQ ID NO: 228016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtgggtacgcggtgaggaattaagcgact

SEQ ID NO: 228017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtgggttccaggacacgtttgggccttgc

SEQ ID NO: 228018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtgtcgatgcgcaatgaagtcgggcgtcc

SEQ ID NO: 228019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtgttctaccattcacggttcttctcctg

SEQ ID NO: 228020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtgttttggggcgtgctccttgttcgggt

SEQ ID NO: 228021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgttagaactttgtctagttgctggccagc

SEQ ID NO: 228022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgttcgtggcttatgaccgtttaacttgtt

SEQ ID NO: 228023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgttgagaattagcttaactggtgtgctcc

SEQ ID NO: 228024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgttggttgactggggtcaggggtggctag

SEQ ID NO: 228025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgttttcctcatgtatcatgttagacagtt

SEQ ID NO: 228026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttaaagcaagatcggttttgccatcagggt

SEQ ID NO: 228027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttaacagcaggagatttgcctcgtgcccac

SEQ ID NO: 228028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttaatacttattggaaatgcatgtgggtga

SEQ ID NO: 228029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttaatcgatcgagctttttttcagaggcgc

SEQ ID NO: 228030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttaattctgcgctgctcctgaggcgttctg

SEQ ID NO: 228031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttacaattgcgacaagtgtccccggtaact

SEQ ID NO: 228032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttaccgggtccagggtgcaatcctgcttta

SEQ ID NO: 228033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttaccttaacgcggtcttactccggctcaa

SEQ ID NO: 228034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttacgcggcatgatgtatctatgtccagcc

SEQ ID NO: 228035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttacggtcggatcctgcatgctatcgcctt

SEQ ID NO: 228036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttacttttgtgcgcttattatcctggtacg

SEQ ID NO: 228037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttaggatttaatccgccctcctgtagcttc

SEQ ID NO: 228038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttaggctcggtgtccagaatgcgtgtccgt

SEQ ID NO: 228039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttaggtattcacgcacgcactgcccctttc

SEQ ID NO: 228040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttagtctgacggtaagtttatggagggatt

SEQ ID NO: 228041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttataatgataacttttgatttccctaaag

SEQ ID NO: 228042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttatacgcactcggctatttttatatttgg

SEQ ID NO: 228043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttatctttcacatctagcgcatgcctacaa

SEQ ID NO: 228044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttatgatctttgctgaacgttgtggctcac

SEQ ID NO: 228045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttatgatgcagttcgaaagcgtgggggact

SEQ ID NO: 228046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttatgtctcgcttgctcaacgccacattta

SEQ ID NO: 228047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttattaaagttctgtaaggtcgcatcaaag

SEQ ID NO: 228048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttattaaatgatgtgctatcggtgccctgg

SEQ ID NO: 228049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttattgccctgccccaaagcatagggatac

SEQ ID NO: 228050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcaaacgccaaacgttacagttgtgcaaa

SEQ ID NO: 228051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcaaagtgcgctagttcacttcttttgtg

SEQ ID NO: 228052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcaaatgttctagacttcagttttgttgt

SEQ ID NO: 228053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcaaggattcactgtggataaatgtctcg

SEQ ID NO: 228054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcacatccttaacagtcccgatccattaa

SEQ ID NO: 228055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcacgctaactctccttgtttcctcactg

SEQ ID NO: 228056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcagaggaatcccattaagactaatcgcc

SEQ ID NO: 228057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcatcatatgggctgtttccatgtcttga

SEQ ID NO: 228058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttccactactttaccggatttctcaacaac

SEQ ID NO: 228059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttccctggatgctattcggggggcgatagc

SEQ ID NO: 228060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttccggtacttgtcctttttacgtaggggc

SEQ ID NO: 228061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttccgtgtttaatgctattgctccctcagc

SEQ ID NO: 228062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcctacatctactctttgagagggcccca

SEQ ID NO: 228063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcggcatggtttcgggtatgtacgttttt

SEQ ID NO: 228064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcggttaacgggaaacctgtactggacca

SEQ ID NO: 228065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttctaagcgtatttgagggctatcttctag

SEQ ID NO: 228066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttctacattagccaccattagcattatgtc

SEQ ID NO: 228067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttctctgctgacggtctcaagtcgtgcgtc

SEQ ID NO: 228068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcttccgttggtcattcgtgcccgaaaca

SEQ ID NO: 228069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcttcttcacttttcgattcgtcaaacac

SEQ ID NO: 228070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgaagtttcacggtagtgcatggcgaatt

SEQ ID NO: 228071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgaccgggtaagagtgcacatgaatttac

SEQ ID NO: 228072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgagcgcttaccatgatatccggatataa

SEQ ID NO: 228073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgaggtcttgtttacccctcgatgaaggc

SEQ ID NO: 228074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgatttttctcattatgcggggtaagtta

SEQ ID NO: 228075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgcaaccatattagctcgatccttgcctc

SEQ ID NO: 228076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgcacatgtctgggtatgtggcgagtgtt

SEQ ID NO: 228077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgcatgcctctcgtggtttctaaaaatcc

SEQ ID NO: 228078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgccgtactaggcgactttagtcctccaa

SEQ ID NO: 228079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgcgaagttgtgctttcagaccaaagtat

SEQ ID NO: 228080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgcgatcaacaggcatggtgcgattggcg

SEQ ID NO: 228081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgcgattttcagtaccctttggtccctta

SEQ ID NO: 228082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgcggttttccgtagccagccgtgttagt

SEQ ID NO: 228083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgcgtgttattcttgaaacagagatgggt

SEQ ID NO: 228084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgctatggcaatgggctggcgttagggac

SEQ ID NO: 228085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgctcggcaccgtagccggggggaggcac

SEQ ID NO: 228086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgctttttatgattcttctaataatagtg

SEQ ID NO: 228087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttggactgtgaacgtgctcatgtaacgcac

SEQ ID NO: 228088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttggagacgccagatcttaatccgtggcat

SEQ ID NO: 228089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttggcaacgttgaaaattggcgggttgcgt

SEQ ID NO: 228090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttggcctttttcccagggcgatgagggcgg

SEQ ID NO: 228091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttggggcgtgcgacacgtcttatcgaccac

SEQ ID NO: 228092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgtaattgatctgatgaaagcgccaaatc

SEQ ID NO: 228093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgtagaggtttgccagctattcaagcttt

SEQ ID NO: 228094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgtagggatggatagttattgcgcaatac

SEQ ID NO: 228095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgtaggtggccgcctatgtccgttgtgga

SEQ ID NO: 228096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgtcccacaggtcggatgatttctccggc

SEQ ID NO: 228097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgtgaaattcgatttcgtcgaaaggtctc

SEQ ID NO: 228098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgtgcaagtgttagattgtattgtcgcgt

SEQ ID NO: 228099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgttgtgtccttcgcgacgttttcatata

SEQ ID NO: 228100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgttttttcgttgtttgtttttcagacgc

SEQ ID NO: 228101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttaattatctaaagccttcttgaccagac

SEQ ID NO: 228102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttacatctgttacgcgccgttgtcgcctg

SEQ ID NO: 228103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttacccttaaggatacccgatgcattaat

SEQ ID NO: 228104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttaccttattcccaggggtttttatcaca

SEQ ID NO: 228105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttacggttcggcacctcttataccagtta

SEQ ID NO: 228106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttagtgtgcccccgtgatcaaccgtgact

SEQ ID NO: 228107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttattgcgacgatcaggttggctaagcag

SEQ ID NO: 228108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttcacatgccaggagtgttaaattaatat

SEQ ID NO: 228109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttcacggggtggtagtatgtgaataggcg

SEQ ID NO: 228110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttcactcaagcgtagagttattcctgctt

SEQ ID NO: 228111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttcattctatttgttgagactcatgtgag

SEQ ID NO: 228112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttccaccgtactgatatttattttaactt

SEQ ID NO: 228113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttccacttcccgcacagagtctatgctcg

SEQ ID NO: 228114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttccctctatccgagaaccgtagcctgca

SEQ ID NO: 228115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttcctccgtagcttatcgttctgtaggtt

SEQ ID NO: 228116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttcggtcatagttagtttaagacacgatg

SEQ ID NO: 228117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttctattttgcaggttagggcctgtttga

SEQ ID NO: 228118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttctctcgcccttatctcatttggcgaat

SEQ ID NO: 228119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttgagagtctacgtgtccccccaccgctg

SEQ ID NO: 228120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttggcacagcatttgtcactttttgcctc

SEQ ID NO: 228121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttggtccttgatttttcctgtatgcggcc

SEQ ID NO: 228122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttggtgccccatccaaagtcccacggaaa

SEQ ID NO: 228123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttgttttttgttacagttagttcaatgtt

SEQ ID NO: 228124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttttccgattgattccccttgggtagctgt

SEQ ID NO: 228125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttttcttaatcatcctgtatttgaagaagg

SEQ ID NO: 228126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttttgagaggggagtccctctggtttcggt

SEQ ID NO: 228127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttttggctttacttgctaagtaatacctc

SEQ ID NO: 228128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttttggggtggatacgtgggtgggttatg

SEQ ID NO: 228129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttttttccgcctaattacatttgcccggga

SEQ ID NO: 228130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttttttcagatgtctatactaacatcgtt

SEQ ID NO: 228131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaaagcagaatgagtgtgtctcggcaattc

SEQ ID NO: 228132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaagccttgcccttcatccgcgcgctcggg

SEQ ID NO: 228133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaaggattcactggtggggaagaacggtgg

SEQ ID NO: 228134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaagtgggctattttgtgtaagttgagctt

SEQ ID NO: 228135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaatagggtaaagtccatacttcggacgcc

SEQ ID NO: 228136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaatccatgaacatcccacagctataagta

SEQ ID NO: 228137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaatcctggtccttgtcaagtcttaggctg

SEQ ID NO: 228138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaatgttcgggctccaggtagtttatctgt

SEQ ID NO: 228139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaattggcattaataaacgtcaacctggga

SEQ ID NO: 228140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacaacagtgacggatatttgcgaaacagt

SEQ ID NO: 228141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacacttagttaagatttctgtgtttatgc

SEQ ID NO: 228142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacaggaccacaaactcttagagagcaagg

SEQ ID NO: 228143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaccacgatcatgcagttgtcgaagcggat

SEQ ID NO: 228144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaccccactgtaaattagctagtcgctgcc

SEQ ID NO: 228145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacccgctgtgaagagtaattcgcaaacgt

SEQ ID NO: 228146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaccttgtaccagcttattttcgctcaaaa

SEQ ID NO: 228147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacgacgcaatttattgatattgagcgagg

SEQ ID NO: 228148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacgagcttcgaacttgtatgcatgagcat

SEQ ID NO: 228149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacttcacaattcttacggtcttgggtggg

SEQ ID NO: 228150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacttcgcccacggcttctcctgatacaaa

SEQ ID NO: 228151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagacaccggggcgttggaacgcgaaccgc

SEQ ID NO: 228152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagagtaattgctggcgccgtgcttccatc

SEQ ID NO: 228153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagcttgtgtcggtttaaagatttcgcaca

SEQ ID NO: 228154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagggatcctctcttgttttacctgacgat

SEQ ID NO: 228155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagggattgctttatccacacttcagatgt

SEQ ID NO: 228156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagtacagtacgtccactataccacgttct

SEQ ID NO: 228157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagtacgcctccgcatattggacgttgaga

SEQ ID NO: 228158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagtccagattccgccctgcattaggaatt

SEQ ID NO: 228159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagtcggggatccttggttttgtagctatt

SEQ ID NO: 228160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagtgctacagattgtggtcgcttagtccc

SEQ ID NO: 228161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaataccatatattcttgtacgcttgctgtt

SEQ ID NO: 228162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatagagatcgggtgacaaggcaactcctc

SEQ ID NO: 228163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatatttttatgcgacgctcaaacggcttt

SEQ ID NO: 228164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatcatttcataaacgctcgggatgttcat

SEQ ID NO: 228165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatcccccttttattccgttctactaccgc

SEQ ID NO: 228166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatccgcttttgctattagcctttgttagt

SEQ ID NO: 228167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatcggttagggggcgtaaagtagctggtt

SEQ ID NO: 228168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatctccagcgttcgtttgtttttgctcac

SEQ ID NO: 228169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatgctcactagtgacacgttaaacatacg

SEQ ID NO: 228170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatggttttgtggtttcaggaagcggttta

SEQ ID NO: 228171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatgtgcatgcggttggttcaagggacggg

SEQ ID NO: 228172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatgttctcgaacgatcatactccatcggg

SEQ ID NO: 228173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaattatattttgacctttcctgatttatct

SEQ ID NO: 228174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaattcactgtacatcatagtcccatgtaca

SEQ ID NO: 228175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaattgttacaagcctaatatgctctcagaa

SEQ ID NO: 228176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatttttcagatagtggtgttgcaatcaat

SEQ ID NO: 228177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacaattgacgtcgaaaataacttggtcggg

SEQ ID NO: 228178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacacaatgagatgtcacgtttttggttgtg

SEQ ID NO: 228179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacacgggccaagttttcggtccacattatt

SEQ ID NO: 228180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacacgtcggtggtcgctctgaaaccaacta

SEQ ID NO: 228181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacactctcgtcaagttcattgccaaaggcc

SEQ ID NO: 228182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacaggcacttcggaaaaacgctacggggcg

SEQ ID NO: 228183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacaggctgtaatactactgcaggaccgtat

SEQ ID NO: 228184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacaggtttcattgtgcctggtccacgatgg

SEQ ID NO: 228185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacagtattcacttagcataaacgctacctg

SEQ ID NO: 228186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacagtctttgtgatccgaccttcgcgctaa

SEQ ID NO: 228187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacatcactagagtgtcacaggtaatcacta

SEQ ID NO: 228188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacatcatgcaaaaacattcaatttcagacg

SEQ ID NO: 228189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacatcggtattagcatgcacagcagagcgt

SEQ ID NO: 228190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacatgttttggaatagcacagttgtagtgt

SEQ ID NO: 228191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccaatggcccgtggtgttacgcaatagac

SEQ ID NO: 228192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccaccattattaactttgtgactgcggca

SEQ ID NO: 228193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccagtcggctcgtctagcccgggccaagt

SEQ ID NO: 228194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccatgcaagctgtttcaacatccgcactg

SEQ ID NO: 228195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacccctacgagcgatgttttactgagagat

SEQ ID NO: 228196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacccggctcaatattgcagctttattatct

SEQ ID NO: 228197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacccggttttccaattcttatagatttcct

SEQ ID NO: 228198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacccgtgtggcaatagcgtcgaccaatgag

SEQ ID NO: 228199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccgcggcacacctttcatcaaagacttgg

SEQ ID NO: 228200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccggaactaccggtacttgatcttggtgg

SEQ ID NO: 228201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccggtgtaatgtgttgacgcaccgttacc

SEQ ID NO: 228202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacctacgcttatcgtgtctttaggtggcta

SEQ ID NO: 228203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacctacggcgagcatggccgcgtgtgacat

SEQ ID NO: 228204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgaagattcgacttaggcggaggggatgt

SEQ ID NO: 228205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgcacctggcctctaacgcatcgggggca

SEQ ID NO: 228206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgcatgtagcttcattctaccattttggc

SEQ ID NO: 228207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgccaatctgccctacattcctacgtagt

SEQ ID NO: 228208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgcgttcggagcctaatcagttctggctt

SEQ ID NO: 228209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgcgttgacgagaagaacttctcagcgtt

SEQ ID NO: 228210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgcttccctgcaaaaacgataatccttct

SEQ ID NO: 228211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacggaaatatttgtggcgtctgtcaggatc

SEQ ID NO: 228212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacggcgaaatacgcattggtgctgcttggg

SEQ ID NO: 228213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgggcggcttctctcaaggcaaatgacca

SEQ ID NO: 228214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgttacgcatacctttgataaggcctgca

SEQ ID NO: 228215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgttgtatcactaagtggtaagatcctag

SEQ ID NO: 228216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactaatgaaatgtccgttcgcaccacctag

SEQ ID NO: 228217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactacacacgtcgggtgttgaggtcgtaac

SEQ ID NO: 228218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactagacggacgttgcgagtgttaggggat

SEQ ID NO: 228219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactagagccttttctcggggcgcacagtgt

SEQ ID NO: 228220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactagccgctgcttactaatagataagaag

SEQ ID NO: 228221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactaggggatgaacacgggctgtaatcctg

SEQ ID NO: 228222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactagttacttatgaaatgtctagcgtcgc

SEQ ID NO: 228223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactattcgttccgaaccaaatgtgcgactg

SEQ ID NO: 228224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactccatgatattagcgtgcccaggcctcc

SEQ ID NO: 228225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactcgagatagactggatcctaatgaccgg

SEQ ID NO: 228226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactctctttctggaatgcattttgtattca

SEQ ID NO: 228227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactctgcgttccacccgcccactaatgagc

SEQ ID NO: 228228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactgcagtatcatgagtgtatcctgcgctg

SEQ ID NO: 228229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactgccggagcttttgaatcaccgttagat

SEQ ID NO: 228230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactggccatgcccgaccgcgatgcacatcg

SEQ ID NO: 228231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactgtacctcagtggaaccagcgccaattg

SEQ ID NO: 228232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactgtagtatttgatagacccgcgttcatt

SEQ ID NO: 228233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactgttgaaccaccttgcttaattcgggca

SEQ ID NO: 228234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacttcccttcgttattggcccgtgtcgagt

SEQ ID NO: 228235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacttccgatgaatggaattatgtaacgaac

SEQ ID NO: 228236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacttcgaagatttaccagctagtgctgcgg

SEQ ID NO: 228237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacttgtggtgttctcggttctccgcggatc

SEQ ID NO: 228238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactttgcgggggaggtccgggtgagcattg

SEQ ID NO: 228239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacttttgtgtgcgagccctaatatttcggg

SEQ ID NO: 228240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagaacttaagcgtgctactttaaccgattg

SEQ ID NO: 228241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagaagtagcgcagcgcgcactgtgggcgga

SEQ ID NO: 228242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagaatacatcatgcccgagactgtctggag

SEQ ID NO: 228243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagaatatactcatcccagccgataaccggg

SEQ ID NO: 228244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagacacccattgcgccacgagttaattgct

SEQ ID NO: 228245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagacattccgacacggaggctagctaaggg

SEQ ID NO: 228246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagacgccgcgttaactataagtaacaagcg

SEQ ID NO: 228247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagagaggggaccgacttcccggttagtgtg

SEQ ID NO: 228248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagagcggttcagactgttccaatcggcctc

SEQ ID NO: 228249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagaggcctcttcgccatgaggataacgtct

SEQ ID NO: 228250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagatcatcagttgcctttagttacacagtg

SEQ ID NO: 228251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagattagtctgaaggagctgtattcctttt

SEQ ID NO: 228252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcaattcggacagggcgggtcgtatactt

SEQ ID NO: 228253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcaatttgtttgaggcaatgcaacgtcaa

SEQ ID NO: 228254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcacagtggtatgagattgttacgggaag

SEQ ID NO: 228255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcaggtcgggagcgacaggtcgtttgccg

SEQ ID NO: 228256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcgtccgctatgttaagaattgaactatt

SEQ ID NO: 228257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagctggcagtgacgctgagcggatgaaagc

SEQ ID NO: 228258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagctggtgaatcatgcacatatgttgcagc

SEQ ID NO: 228259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggaacataccgctcgtactgaattcgccg

SEQ ID NO: 228260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggaatagttggtaggtgcaggttggggtg

SEQ ID NO: 228261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggacctctcttggttaatgcaactttggt

SEQ ID NO: 228262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggagacagctatcgagtttgtcgaacacg

SEQ ID NO: 228263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggagcagactatcagtgccaggatcgaga

SEQ ID NO: 228264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggatgacttcagagcgacggacacgctta

SEQ ID NO: 228265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggatgtttacgatcccctttcgttgatgg

SEQ ID NO: 228266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggctcggaggggtggttgtcatgctaccc

SEQ ID NO: 228267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggctggattgcaagagcatcactatctat

SEQ ID NO: 228268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagggcagcacgtacggatcataatcgattt

SEQ ID NO: 228269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagggtaacttcgcatgaataggacgtcgag

SEQ ID NO: 228270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagtactgaccatgactttccttccccggcc

SEQ ID NO: 228271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagtcaatctaagcttacgttattgtacctt

SEQ ID NO: 228272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagttagcgctagtctaatagctggtggcga

SEQ ID NO: 228273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagttcccaaacatgtgtcttccgggtaagt

SEQ ID NO: 228274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagttgccagaggatttaccgggcagatgtt

SEQ ID NO: 228275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgataagctactgtaactctgcacggaataat

SEQ ID NO: 228276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgataagctgtatgacgctcgggggtgcgaac

SEQ ID NO: 228277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgataccgttacccttatgaaattgcgcgagc

SEQ ID NO: 228278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatacgggactttcgagattagtgtattcga

SEQ ID NO: 228279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatactgtttttgtgtgataccacttttgtc

SEQ ID NO: 228280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatagctgcattgttctcccggtacgtccaa

SEQ ID NO: 228281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatagtgaaggacttaatcattctcagtcat

SEQ ID NO: 228282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatatagggggcacgggtctaggtgcgaaca

SEQ ID NO: 228283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatatatgagctcaagattatcgcggcttca

SEQ ID NO: 228284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatatcggtttcgtccggaacacttattcca

SEQ ID NO: 228285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatatctctcagtgattcaccctgtatcaat

SEQ ID NO: 228286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatatgtggtctcgacaccggtacccacaca

SEQ ID NO: 228287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatattaggggtggtatgcgtatattgacct

SEQ ID NO: 228288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatattgtagacttacgtgtttgattgttct

SEQ ID NO: 228289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatccaactgatgcatacgggatggcgaaac

SEQ ID NO: 228290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatccccttttctcgtttcggtgtgcagcta

SEQ ID NO: 228291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatccgatgcgaggaagcagcatgtgtacgc

SEQ ID NO: 228292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcctactgtacgtaaagggggtgcctaga

SEQ ID NO: 228293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcctcgctggtttcggtccaatctctgct

SEQ ID NO: 228294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcgagtggggctggcgtgtttaggtgtcc

SEQ ID NO: 228295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcgcatctacgtactcacacggggattct

SEQ ID NO: 228296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatctaccacgcactgaataggattcgttgt

SEQ ID NO: 228297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatctgagaataatgcttgagaacaaaccct

SEQ ID NO: 228298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcttttggagtgttttgacatggctattt

SEQ ID NO: 228299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgaacactacgtgatctagggtccggggt

SEQ ID NO: 228300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgactgcgggaatgaatgagtacagtagt

SEQ ID NO: 228301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgatcatgtggtgttatgggtgttgacga

SEQ ID NO: 228302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgatgctatggttgaagtcccgagcgctg

SEQ ID NO: 228303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgcacgtgatgtctgatctcaggtgggtc

SEQ ID NO: 228304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgcattacggttcagctacagattgacgt

SEQ ID NO: 228305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgcccgggtttctggagttaattccttac

SEQ ID NO: 228306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgggagcatgatatccctcttttaaggtt

SEQ ID NO: 228307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatggttacgtgcagtagttccgtacggctc

SEQ ID NO: 228308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgtaaggcctctaggtctgtttgtcgggg

SEQ ID NO: 228309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgtacttcgtggattcgggtggcgggctc

SEQ ID NO: 228310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgttgagtgttgcgtagattgtctggtct

SEQ ID NO: 228311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgttggctactcacggtagagtacagttg

SEQ ID NO: 228312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgtttcaagtgcatagcatctacgagcct

SEQ ID NO: 228313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattaagaaaccgtatacgcactgcttagcc

SEQ ID NO: 228314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattaggttttgtgcataaagaatactaagc

SEQ ID NO: 228315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattatgcccgcatgtgatacttctgcgtca

SEQ ID NO: 228316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattccggggcgacgacccggcctgtggcaa

SEQ ID NO: 228317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattcctgaagtgtactgaaaattaccctct

SEQ ID NO: 228318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattctacgaagtgacctttgtagggaggct

SEQ ID NO: 228319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattctgcacatacactggtgtctgttagtc

SEQ ID NO: 228320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattgattcaacttgggatgtaataagggtc

SEQ ID NO: 228321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattgcgcatggtaggcgctaggtttcgaaa

SEQ ID NO: 228322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattggtcgagaacttcgagtccttttattc

SEQ ID NO: 228323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatttatctcgttggtatgtccgctcagatc

SEQ ID NO: 228324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatttcactatgaagattagtgggattgcaa

SEQ ID NO: 228325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattttcaggctcattggacgcataccggtc

SEQ ID NO: 228326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattttccgtggaaggaggtggacgtttggt

SEQ ID NO: 228327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattttgtaggactgcaagccctccgcccaa

SEQ ID NO: 228328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaacatccaggaccacggcgcacgaagcg

SEQ ID NO: 228329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaaccaatgccgtacacacgttttcggtc

SEQ ID NO: 228330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaactagtcctcgtcaatgctgagtcaca

SEQ ID NO: 228331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaactgccgactgaggggtctgtgttcac

SEQ ID NO: 228332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaatactagggtgaacgttgactcccgta

SEQ ID NO: 228333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaacaggcttaatgtcatcatcacatatac

SEQ ID NO: 228334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaacatgtcgcattgttattatgtgtaacg

SEQ ID NO: 228335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaccagttgtctgtccacgcatgcaattg

SEQ ID NO: 228336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaacctcccggtaatatacttctgctgctt

SEQ ID NO: 228337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaacctgaccctttggtcgttgacagcaat

SEQ ID NO: 228338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaactcgcgaattaagcggggtcaacgatt

SEQ ID NO: 228339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaacttaataggaaggtgtttgtgatagat

SEQ ID NO: 228340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaacttttctcgcatctgtgggggcttgtc

SEQ ID NO: 228341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaagagcctttcttttgtttgagtatcgta

SEQ ID NO: 228342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaagagttagtgactacagaatcttgccac

SEQ ID NO: 228343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaagatgtacggaagagtgagaatagacgt

SEQ ID NO: 228344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaagcatgtttaactttctggtcggacccg

SEQ ID NO: 228345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaggaaggacttgtgtgtatatgatatga

SEQ ID NO: 228346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaggggacaagtttttccgggctttttta

SEQ ID NO: 228347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaatattggacgtgaggtagttgcttttgg

SEQ ID NO: 228348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaatcctgactcttgttcttgaagtctccg

SEQ ID NO: 228349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaattactatcgaagtctaacggtttttct

SEQ ID NO: 228350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaattcaaactggtatgtgaggacaaggcg

SEQ ID NO: 228351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaatttttcgcataaccacgaccatagggg

SEQ ID NO: 228352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacaacgatctgtttggccagcgtggtttc

SEQ ID NO: 228353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacaagagcgtgattgataggcataatctc

SEQ ID NO: 228354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacaattcctagtacactaaatatattgtg

SEQ ID NO: 228355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacacgagacactggcctttagtgacgcta

SEQ ID NO: 228356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaccaccaattgacgttaattagactcctg

SEQ ID NO: 228357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaccagtgttagtgtggtgacggtcacgtc

SEQ ID NO: 228358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaccatacgcacacgtagaagagagcatgg

SEQ ID NO: 228359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacctccgtagagagtactcctgacgtcat

SEQ ID NO: 228360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacctgattatctattcggtgtatggaggc

SEQ ID NO: 228361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaccttgcgctctatccatggttcgaatcg

SEQ ID NO: 228362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgagactaacgatattctccgtgcggga

SEQ ID NO: 228363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgatgtgctgtattacactttgtgctac

SEQ ID NO: 228364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgccgctcccttgttctcaggcataggt

SEQ ID NO: 228365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacggatgtagtggagcgtgtcttatcgtg

SEQ ID NO: 228366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacggcagttttcatactcctaaaaggtag

SEQ ID NO: 228367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacggccatagtaacagttttaaagttcgt

SEQ ID NO: 228368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacggccggtcgaagaaagtcgtgtttcgg

SEQ ID NO: 228369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgggctgctcgattcttgcttcctttgg

SEQ ID NO: 228370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgtaatccctcttcacaagtattatgct

SEQ ID NO: 228371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcactcaccggattggcacctgttggtcggt

SEQ ID NO: 228372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcactcagtgtttatcctccattcctgcgtg

SEQ ID NO: 228373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcactcattctgatgatctgggagcctgcct

SEQ ID NO: 228374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcactgcatgtttatttattttttctcggtt

SEQ ID NO: 228375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcactggcctaagctgctaccatgcccgctt

SEQ ID NO: 228376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcactggctcaacgggatctagatactcctc

SEQ ID NO: 228377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcactgggttatgaaggaccctccgcgtaat

SEQ ID NO: 228378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcactgtctcatagcaggatggatatctgaa

SEQ ID NO: 228379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacttacagtcacgtggatggcaggggccg

SEQ ID NO: 228380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacttatcgtttgcataggttggttccggt

SEQ ID NO: 228381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacttcacggctacgaggtggaggccttct

SEQ ID NO: 228382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacttcatatcttccgttcctatagtccat

SEQ ID NO: 228383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagatatggccgtcatgtacagtcatgggc

SEQ ID NO: 228384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagcacttggcagaatcgttgtttaagggt

SEQ ID NO: 228385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagcatctgccggtcctcgggtgtaaggat

SEQ ID NO: 228386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagcgaaacagttcagaatggccaccctag

SEQ ID NO: 228387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagcgttaatttccaatcaccgtcagggtc

SEQ ID NO: 228388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagctgtaatctcgccttttcgtaatatgg

SEQ ID NO: 228389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagggaaggaaagccggtccccacgaggga

SEQ ID NO: 228390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagggcaagattgttattattctacatagc

SEQ ID NO: 228391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggggtctcgggttcacctagttgtaagt

SEQ ID NO: 228392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagtaaaacaactgaagccgcacctcgatc

SEQ ID NO: 228393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagtactgttaagtccgtagtggtcccgaa

SEQ ID NO: 228394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagttttgtcctccccggatttggcgggta

SEQ ID NO: 228395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatacacgtgttccgttggttcttttaaac

SEQ ID NO: 228396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatcactggtaataggagattctttgctag

SEQ ID NO: 228397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatcatagctgttattcgaaaggaccctgc

SEQ ID NO: 228398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatcattagtccgggagtgtggaggacata

SEQ ID NO: 228399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatccctaccggctcatctggtggagcgat

SEQ ID NO: 228400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatcgcttgctgaacggcaaatgaggcccc

SEQ ID NO: 228401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatctccgcgtagcaggtgtcgtgtacgtg

SEQ ID NO: 228402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatctgttcactcagttttctatatgttag

SEQ ID NO: 228403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatgaccctagcagaaattggcaggaccgc

SEQ ID NO: 228404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatgagtattacacaagtcgagtcttgggg

SEQ ID NO: 228405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatggaaagaacacttcttgggtggggaga

SEQ ID NO: 228406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatggttgcacggagggtcacactcttctt

SEQ ID NO: 228407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatgtaatgatacaaatggctgaaggagcg

SEQ ID NO: 228408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatgtcacgatatgtttgggggtagttctc

SEQ ID NO: 228409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatgtcactgcgggactgtggttacaaggg

SEQ ID NO: 228410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattacatggtgccctgtattatgtgttat

SEQ ID NO: 228411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattctggggctctttaacagtatgggtta

SEQ ID NO: 228412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattgcatgcccgtgctcagatatttaggc

SEQ ID NO: 228413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattggcgatcgttgttgaaacgtaagaac

SEQ ID NO: 228414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattggtccttcatcatagtaacaagtggc

SEQ ID NO: 228415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattgtgaaacaccctgttccagacgtgat

SEQ ID NO: 228416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatttctatctgctacccctggctcacttc

SEQ ID NO: 228417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatttgccaggcgcttatactgatgacttc

SEQ ID NO: 228418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattttcacgctggtagcacgagctctgac

SEQ ID NO: 228419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaaacggagaaaacatcgtctggacagct

SEQ ID NO: 228420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaacggtgtttttaaacgcttcgaggatt

SEQ ID NO: 228421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaactatggtggtggaatagatacgctgt

SEQ ID NO: 228422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaactcacttcgtcatgagcaggccaacc

SEQ ID NO: 228423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaaggtactatatactacggattaagtct

SEQ ID NO: 228424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaagtacgaccgacgtagcggcatgttcg

SEQ ID NO: 228425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaatggtagtattctatatgacccttgcc

SEQ ID NO: 228426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccactaagtgcacttgactttcgaggcgtg

SEQ ID NO: 228427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaggcaatctaaacatacggcgcacaagt

SEQ ID NO: 228428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagggattctttggtgttgatcggtcgcg

SEQ ID NO: 228429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagtcaagtgtgggtacatcgtgaaggcc

SEQ ID NO: 228430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccatatagaggttgtattatatggcttcta

SEQ ID NO: 228431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccatctcggcacgatactcataagatgcgg

SEQ ID NO: 228432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccatgtactagatttcagtttgtgcgccac

SEQ ID NO: 228433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccattttcgcgtctttgtcctctcctcaga

SEQ ID NO: 228434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccaagctttgttgcggtcatttcctttgc

SEQ ID NO: 228435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccacgataccgatggttctcttctgaggc

SEQ ID NO: 228436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccagcagctctaactgttcactcccgctg

SEQ ID NO: 228437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccagtctggaaatcccgggtactcggcta

SEQ ID NO: 228438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccccgataagccaaactgcggcggtgttg

SEQ ID NO: 228439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccccttatacgcgaactgattgcgaagga

SEQ ID NO: 228440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccccgtcatcaagtctgttatcgaacggtc

SEQ ID NO: 228441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccccgttggagattcagttattagggaaag

SEQ ID NO: 228442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccctgtgtttaagcggtaaaagcgcgatc

SEQ ID NO: 228443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgacttaatccggaagtgcaaagatggt

SEQ ID NO: 228444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgaggcatgggatcccccccgtttcagt

SEQ ID NO: 228445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgccaactgcaagagggcgtgaatgccc

SEQ ID NO: 228446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccggatgatgatgttctccgaggttctgc

SEQ ID NO: 228447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccctcggcctctacgtttatacgggttatt

SEQ ID NO: 228448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccctctttgctggcatacggcaagaatcat

SEQ ID NO: 228449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccctgggtgctgccgtagtacatattagaa

SEQ ID NO: 228450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccctttttatgacctattcgattgtttttc

SEQ ID NO: 228451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgaaagaggctcacgtttctaccattacc

SEQ ID NO: 228452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgaaataacttcacagcttttacgagtcc

SEQ ID NO: 228453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgaaatagggtagctttgtataggctcga

SEQ ID NO: 228454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgacatcgaaatacattgatcctaattag

SEQ ID NO: 228455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgacgtgactgacggctatttgtataggc

SEQ ID NO: 228456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgagtcaagtcggagcgtgacggtcgcgt

SEQ ID NO: 228457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgatttaatgtgaagaccttttcgttgta

SEQ ID NO: 228458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgatttgttcgttaatgttcagaccagta

SEQ ID NO: 228459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgctaaggcatcgatttggttcccgccct

SEQ ID NO: 228460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggcgacgcagatacacatgagtacgagt

SEQ ID NO: 228461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgggcaataataacgggatgtaatgggga

SEQ ID NO: 228462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgggggccatgttaagcgaggaactagca

SEQ ID NO: 228463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggggggtatccgggtaggctattattaa

SEQ ID NO: 228464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggttagccacacgaggttactcactcgt

SEQ ID NO: 228465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgtagtcctgagatagtcttgcgatggtc

SEQ ID NO: 228466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgtcagattacggtcgtgctctttgtaac

SEQ ID NO: 228467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgttcccgatgtagtatgtatctagtcga

SEQ ID NO: 228468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctaaactacacattgtgaaagcttggaag

SEQ ID NO: 228469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctagaccaagggactgtttttctcagtta

SEQ ID NO: 228470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctcacatcaggttagacgtcggcacatgg

SEQ ID NO: 228471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctcatagtcgggccttgatccatcggtaa

SEQ ID NO: 228472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctcgaattgtatcgtagtggtaatattat

SEQ ID NO: 228473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctgacaacccggcgaagtcagatctctac

SEQ ID NO: 228474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctggctaatttccttgtccggaagtttag

SEQ ID NO: 228475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctggggaccgcaagggtatattggtgcgg

SEQ ID NO: 228476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctggtctgccattttatcatttccgatag

SEQ ID NO: 228477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctgtactgaggtaggcctgcgtggttggt

SEQ ID NO: 228478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctgtcggcaggaatgcactattggaaggg

SEQ ID NO: 228479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccttacatcgtctcagcattatcaaagggt

SEQ ID NO: 228480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccttatctccacgcatggatgtactttgtc

SEQ ID NO: 228481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccttcggggtcaagctctaacagcaacctg

SEQ ID NO: 228482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccttggggaatccggcaaagtaggactatt

SEQ ID NO: 228483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccttggtataggatttcaccgccgaagctt

SEQ ID NO: 228484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccttggttatagtccgggatcgccatgagc

SEQ ID NO: 228485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctttaatttctggagcttcagagtgccca

SEQ ID NO: 228486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccttttccatacgaggaacacttggttttt

SEQ ID NO: 228487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaactcccatcacttcgtaatgctcttgt

SEQ ID NO: 228488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaacttagtagtcattcaaattacatcac

SEQ ID NO: 228489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaagcaggaacgacaccgttactagttgc

SEQ ID NO: 228490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgacacacgggtgaaactggttttgctggc

SEQ ID NO: 228491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgagccatcggcgctagatgctatgaattg

SEQ ID NO: 228492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaggccctctgaacaattggtctaaagtc

SEQ ID NO: 228493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaggtattgcatcttacgtgatgttcagt

SEQ ID NO: 228494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgagtccttcatcacgagacatcgaggcgg

SEQ ID NO: 228495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgagtttggtatgtgctgctccttgcggca

SEQ ID NO: 228496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgatgatggtgactttctttatctattacg

SEQ ID NO: 228497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgatgttggcagcacgaggaagggatggcc

SEQ ID NO: 228498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgatgtttcgccgtatttccaagagcccct

SEQ ID NO: 228499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgattaggagagcgattgtacgaccacgtg

SEQ ID NO: 228500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgattcatttggggcggttggttaaagggg

SEQ ID NO: 228501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcaaccctcacgcgcttatttaaaacgct

SEQ ID NO: 228502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcactatctccaccccgtgccgtcggtct

SEQ ID NO: 228503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcagaggaattaaattacaaccagtcccg

SEQ ID NO: 228504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcataaccacggatacgttattaccagct

SEQ ID NO: 228505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcatacttcataaaactcacttgtgtagt

SEQ ID NO: 228506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcatctagggtcgcaaaagtacatgtctg

SEQ ID NO: 228507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcccataagacgtgttgtctcaaggaggt

SEQ ID NO: 228508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgccccatgatgtgtttcactcgcgttcga

SEQ ID NO: 228509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcccggagactgtcagcacgtgcgattct

SEQ ID NO: 228510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcgagcacagtgtcgggaggcgggggctg

SEQ ID NO: 228511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcgcgtcgttgattgactgttataaacgt

SEQ ID NO: 228512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcgctgaggaggtctgacgatttcttagc

SEQ ID NO: 228513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcggtcaactttatgctccattttgcgcg

SEQ ID NO: 228514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcggtccacgcgtgggtattggcttacca

SEQ ID NO: 228515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcgttgggtttatggtttacttatgtagg

SEQ ID NO: 228516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgctccagaatggaataggtaccccggtct

SEQ ID NO: 228517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgctcctaatgcatcagttgttctgtgctt

SEQ ID NO: 228518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgctcttgtgatgtttgtaaactaggaatc

SEQ ID NO: 228519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgctgtactgtccagggcccgcacacattc

SEQ ID NO: 228520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgctgtctagtcttccgataaccgtacgga

SEQ ID NO: 228521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgctgttaatcgctttagaatggcggagct

SEQ ID NO: 228522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggaagcctgcaacatggccgttgtggcgg

SEQ ID NO: 228523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggaatctctctcgctcgttaaggggagcc

SEQ ID NO: 228524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggaatgtggggaccatattccgagaatct

SEQ ID NO: 228525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggagattaagtgcttggttaggctacggg

SEQ ID NO: 228526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggatctggttcttgctcaatctttctctc

SEQ ID NO: 228527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggattttccgtgatttctcttaacgcacc

SEQ ID NO: 228528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggcatcgatgcagatcgtctttaggctcc

SEQ ID NO: 228529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggcggcggccgtccggggcggagcgagtt

SEQ ID NO: 228530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggctaggcaacacaaacgccaccgcaaat

SEQ ID NO: 228531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggctcaagcttaggcgtgcacatgatagg

SEQ ID NO: 228532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggcttcgttcagagcgctgtcctttcctc

SEQ ID NO: 228533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggcaggcggctcctataacccggcggtt

SEQ ID NO: 228534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggcgaacaacttgtgtcatgcgtctttg

SEQ ID NO: 228535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggggtgcattcgcggaatcacaaaaggtg

SEQ ID NO: 228536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggggttcctctacctttgggcgcatttgg

SEQ ID NO: 228537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggggttgaacgcgaactgcctgaaatgcc

SEQ ID NO: 228538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggtacgagatcaatattgagcggggtta

SEQ ID NO: 228539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtaacgaaactattcacggctctagtca

SEQ ID NO: 228540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtatacgagcgctttgcacagacatgcc

SEQ ID NO: 228541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtatgagtctttgcactagttctctgac

SEQ ID NO: 228542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtatgataatgcgtatgcgaccgtagtt

SEQ ID NO: 228543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtgtaaatgaggagtgggtgcgcgacgc

SEQ ID NO: 228544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggttccagtctcatttgctcattaggtta

SEQ ID NO: 228545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggttcttgaatacccatcacgctagatcg

SEQ ID NO: 228546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggttgttacacgactattataagcgtgtt

SEQ ID NO: 228547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtaatttggatcatcagtccaatttgcaa

SEQ ID NO: 228548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtaccatcaggaacgaccttcaaagggcg

SEQ ID NO: 228549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtacggttccagtcctaccgagtggcgtc

SEQ ID NO: 228550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtagcatctctcctagccccataattgat

SEQ ID NO: 228551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtatcctcatggcccctagacagctgttc

SEQ ID NO: 228552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtattataacactgtgcatgatcctaagc

SEQ ID NO: 228553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtcgattaacacagtcgagctcgaaggtg

SEQ ID NO: 228554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgacactactaggacatacggtcgaccc

SEQ ID NO: 228555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgagataattccgatttcagcttcgtgc

SEQ ID NO: 228556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtggggcaatggctccccgtaagttccct

SEQ ID NO: 228557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgtatggaggggttggcgggacgggaag

SEQ ID NO: 228558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgtggggtttgtggcgacctttgcaccc

SEQ ID NO: 228559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgttagagtaacccgtaatgtccggcgggg

SEQ ID NO: 228560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctaaataggtatatctttatcgttcgtgcg

SEQ ID NO: 228561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctaacactttgcttccctgtgctgtaaacc

SEQ ID NO: 228562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctaaccgccccagttagagatggttaggcc

SEQ ID NO: 228563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctaaggtatcgtgctaagcggtgcgaggtc

SEQ ID NO: 228564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctaatcggggatagtaggttcgttgccacg

SEQ ID NO: 228565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctacagggcgaggcacggattcaaactgat

SEQ ID NO: 228566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctacccattgctcggagaggatcagacacc

SEQ ID NO: 228567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctacctcagctcggaaggagtgtagggtcc

SEQ ID NO: 228568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctacgatcggagtttcccgagtgcatcccg

SEQ ID NO: 228569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctaggaatgcgacttggtaacaccattccc

SEQ ID NO: 228570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctagtagctctatcgtaatcgctgaataat

SEQ ID NO: 228571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctagtccacgaaggtactcgttgcagatgg

SEQ ID NO: 228572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctagtctccgtcgccagtagcccaaaacga

SEQ ID NO: 228573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctatagacatattgactactgctgggtaaa

SEQ ID NO: 228574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctatgatgaaagggagatccttcccgcaac

SEQ ID NO: 228575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcaccgcactcattcgcgttcgctgcggg

SEQ ID NO: 228576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcaccgtttattgggttggagcgaactct

SEQ ID NO: 228577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcacgatccttgactgcgggcgccttagg

SEQ ID NO: 228578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcagaccgtctcaatctatttcaccgggc

SEQ ID NO: 228579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcatcttctgccagtaggtccgcttcggt

SEQ ID NO: 228580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcattcatcttctgccgcggagtgtcacg

SEQ ID NO: 228581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctccatagcacctaggtgtccgacaacttg

SEQ ID NO: 228582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctccccttcgacagtgccgggccggtatct

SEQ ID NO: 228583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctccccttgttcgcgcaccatgtggctcta

SEQ ID NO: 228584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctccgtgatatcactcgttggaggttacgt

SEQ ID NO: 228585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcgccttcacttctcttcggaagagtgct

SEQ ID NO: 228586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcgctacaatctatgcgcctcatggctcg

SEQ ID NO: 228587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcggatgcaggatatacaatcaggtgagg

SEQ ID NO: 228588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcggcccgtttatgcctcgaggtagcttc

SEQ ID NO: 228589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcggtcttacctaaatcgccgggctcgtt

SEQ ID NO: 228590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctctacctacctcattcgagcagatttaat

SEQ ID NO: 228591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctctaggattgccattactgtatccgtagc

SEQ ID NO: 228592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctctatctgtttgtacagtcgaaatcaatc

SEQ ID NO: 228593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcttccaaaccgccaacaggataacgccc

SEQ ID NO: 228594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgactagtcgcctccatatgcatccctct

SEQ ID NO: 228595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgatacgctacctttcaagggtttatgga

SEQ ID NO: 228596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgatatgcagcgcgatctactcgatcgac

SEQ ID NO: 228597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgatatgtgtattaacgaggattagatct

SEQ ID NO: 228598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgcatcgctctagaacttggcagcggcca

SEQ ID NO: 228599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgcctatataataataatgccgagtaccc

SEQ ID NO: 228600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgctaatgactaaccgtatctgggtcttt

SEQ ID NO: 228601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgctcagccatccggttcactttgaaagg

SEQ ID NO: 228602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctggaatgttgtttcaatgccactcgaact

SEQ ID NO: 228603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctggatgaaactggaatggcgcggtagttt

SEQ ID NO: 228604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctggccacatcgattagtatcgcgaatcgc

SEQ ID NO: 228605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgggctcactgaacgacgtgccatgcgtg

SEQ ID NO: 228606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgggtcctttactctcgggtaagactcat

SEQ ID NO: 228607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgggttaatatctttagttaaagtaagta

SEQ ID NO: 228608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctggtcctcagaaacctcaacttactttct

SEQ ID NO: 228609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctggtgtttcagagtgtttgtaatgtataa

SEQ ID NO: 228610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgtgaccttattgtaacttggcacaattg

SEQ ID NO: 228611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgtgttatgcctacatgggttaaggtcgt

SEQ ID NO: 228612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcttaataatcgtggttgtcacccccatttt

SEQ ID NO: 228613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcttacatgtacaatgcgatagagatatttg

SEQ ID NO: 228614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcttaccgaggcgtcgttcttctaagtccga

SEQ ID NO: 228615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcttacctggccttctcgaccgtctttctac

SEQ ID NO: 228616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcttactactattggcggagcttcgatcaca

SEQ ID NO: 228617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcttcaagttcttctatgttgtctggtgtaa

SEQ ID NO: 228618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcttctgaaaggtaggggtaggacgcaggca

SEQ ID NO: 228619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcttcttgaatagttggggcttctcggggag

SEQ ID NO: 228620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcttgaagtttatttggtgaaacgagactcg

SEQ ID NO: 228621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcttgagtaatactgggataacggcgtatgt

SEQ ID NO: 228622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcttgatcgcagacgttcagtctctcctaca

SEQ ID NO: 228623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcttgcaacaagtctctacctatttcgctat

SEQ ID NO: 228624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcttgccgggggctcgagtatcattggggtg

SEQ ID NO: 228625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcttgcgagacagctcgatattgtaatttcc

SEQ ID NO: 228626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcttggctcttgtgagaatctacatgttcca

SEQ ID NO: 228627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcttgggactaaatgttcgggcccggccagg

SEQ ID NO: 228628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcttgggatcgactccacagttctcatctat

SEQ ID NO: 228629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcttgtcagtccaccagcccgaatggcggta

SEQ ID NO: 228630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcttgtgaagacgtgtgatatcctttctttc

SEQ ID NO: 228631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcttgtgtttcttgagagactgcggcatgtc

SEQ ID NO: 228632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctttacggtgctgccgttgcaatttccctg

SEQ ID NO: 228633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctttcccgggaggtcaaacataggtacgag

SEQ ID NO: 228634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctttcctgcttcgacactatttgcaagtaa

SEQ ID NO: 228635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctttgactcctggtagtcatacttctgtaa

SEQ ID NO: 228636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctttgcagggtacaggtgcaaaccttttgg

SEQ ID NO: 228637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctttgcgtttggctggcgctgtgtcggcgg

SEQ ID NO: 228638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctttgtctaaaagttgggtgtttggctccc

SEQ ID NO: 228639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcttttatcgctaacgtacagtatctaggat

SEQ ID NO: 228640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcttttgtaaatgaaaatgctgtcgaaagtt

SEQ ID NO: 228641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcttttgtctcaattctccgttgcagggagt

SEQ ID NO: 228642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctttttatgagtggtcggccgtgattatgc

SEQ ID NO: 228643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaaaaggaggttgtttgttgagttttgttt

SEQ ID NO: 228644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaaaagttctccttgtttctataagacttg

SEQ ID NO: 228645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaaacaacgtaagagccgacgctcggtgcg

SEQ ID NO: 228646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaaaccagcgtagtgtgcagtgggctgatg

SEQ ID NO: 228647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaaaccggagctcttcacggtagggtagtt

SEQ ID NO: 228648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaaactcggtagctgttatgcgttacagta

SEQ ID NO: 228649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaaatataccacggcaactataggtcgtgc

SEQ ID NO: 228650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaacaggggggtctgcgtatcaggcttata

SEQ ID NO: 228651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaactaatgcactccaatcgtttgcgtttc

SEQ ID NO: 228652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaactgtggaaaaacgattggcctttgcgc

SEQ ID NO: 228653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaagcacgttcttgtgataggcccttgggg

SEQ ID NO: 228654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaatgcacgacgaggtggatgatgccagag

SEQ ID NO: 228655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaattccggttgctacagatatagggtaag

SEQ ID NO: 228656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaattccgttcgaggccaccctgttggaac

SEQ ID NO: 228657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaattggttttcatagcttccccttgagac

SEQ ID NO: 228658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaatttattacggcggtggtgcttttttcc

SEQ ID NO: 228659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaattttatttatcaaagcaaggcagcgta

SEQ ID NO: 228660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggacaaagacgcatcccatctccttgtcaac

SEQ ID NO: 228661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggacaagaacgattatgccaggacagtgtaa

SEQ ID NO: 228662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggacactcacttgctcagtggaggtgaaggg

SEQ ID NO: 228663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggacactcgttgtgtcttgcaccgccgcagc

SEQ ID NO: 228664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggacccagatctcgcagtagaatgcgcccat

SEQ ID NO: 228665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggacccatcttgagtattgttttaggcgatc

SEQ ID NO: 228666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaccctcttttgcatgttaacgcttgatgg

SEQ ID NO: 228667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaccgctgtttactacacgtccttatacac

SEQ ID NO: 228668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggacctcacgtcttggctcttcgggatcctt

SEQ ID NO: 228669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggacctgtctggagcctttacttggtgccgt

SEQ ID NO: 228670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaccttctgaggaggatgcagactcgatac

SEQ ID NO: 228671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggacgccgctgatgaggccagaaagaagtta

SEQ ID NO: 228672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggacggctggggacttaaaatgattctggtt

SEQ ID NO: 228673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggacgggtaatgacatgtcggtatgatcgga

SEQ ID NO: 228674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggacgtgactaatattttacttgcgaacttg

SEQ ID NO: 228675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggactcatttagtatcacctgcagcttcaag

SEQ ID NO: 228676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggactgacggcacccggggtatctcgggcac

SEQ ID NO: 228677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggactgcatgttggcaattgagctagttccg

SEQ ID NO: 228678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggactgcggctatggttagggtgcctcttgt

SEQ ID NO: 228679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggactgtttttttttgtttaagtattgtggt

SEQ ID NO: 228680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggacttcgctactaatcaggggaactgcggg

SEQ ID NO: 228681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggagatagtggggaaaatgagcgccattcgc

SEQ ID NO: 228682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggagatttaatgcttaccgggggacctaact

SEQ ID NO: 228683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggagcagttaaataatgttcccccagttaat

SEQ ID NO: 228684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggagccaggtgtacacataggttcatgcgtg

SEQ ID NO: 228685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaggaaatgcaggcgacgtttcagttttgt

SEQ ID NO: 228686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggagggagagattgattggtacgtgcacgag

SEQ ID NO: 228687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaggggctaggcaccgcaaagcaatcgatc

SEQ ID NO: 228688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaggggtctctgcccggtaatactaattac

SEQ ID NO: 228689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaggtacggcaaataaaagcgtcgggccgg

SEQ ID NO: 228690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaggtcctcgtttacacaagtgctcttatc

SEQ ID NO: 228691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaggtggagctgtatggcacttggcgacaa

SEQ ID NO: 228692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggaggttgcatacaggatccggtcagcttga

SEQ ID NO: 228693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggagtctcgctaaccctgcggcatcacctta

SEQ ID NO: 228694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggagtgtcaacattctgcgcaatcacgtgct

SEQ ID NO: 228695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggagtgttcctacctagtgcactagtaagcg

SEQ ID NO: 228696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggatatgaacaatccgggtacctcgttattc

SEQ ID NO: 228697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggatatgtagaggatgccttcggtgcagcgc

SEQ ID NO: 228698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggatcgctagtgcttcagagtcgtttatgcc

SEQ ID NO: 228699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggatcggcgggggtgtagcgtgggtttgtat

SEQ ID NO: 228700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggatctgctggactgtgtatcctaagcgatt

SEQ ID NO: 228701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggatgagtcgcccgtgcgtagatagaccgtc

SEQ ID NO: 228702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggatggatggcaactagttggacgccaccta

SEQ ID NO: 228703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggatgtaattgtacttatgagcaacaacgaa

SEQ ID NO: 228704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggattccaggctgtcaatgctgttcttcctc

SEQ ID NO: 228705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggatttactcggcaaccggctaatggtcttc

SEQ ID NO: 228706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggattttttgtcgtctataggggtcatacgt

SEQ ID NO: 228707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcaacctgctaggggtaaaatgctaataag

SEQ ID NO: 228708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcaactttcaatttacagtcctgacacctg

SEQ ID NO: 228709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcaagcggcttcgcatgtgctgtcgtatta

SEQ ID NO: 228710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcaataggtcgacggcaaggttctgatggg

SEQ ID NO: 228711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcaatcaggtccgggtataggtggtctgaa

SEQ ID NO: 228712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcaatcgctccatcagcgaccgtgggtgtt

SEQ ID NO: 228713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcacaaatggtacgagagacgggccggcat

SEQ ID NO: 228714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcacaataggaatagactttttcgcgtggt

SEQ ID NO: 228715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcacacggagctcgcgtatgtgtcatcagc

SEQ ID NO: 228716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcacaggagggcctttccgggggtctctga

SEQ ID NO: 228717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcacatccgactctgtgttgtaacgcggta

SEQ ID NO: 228718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcactcatttgctctttgtctttagcatga

SEQ ID NO: 228719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcacttcaatctcctctacactagttgagg

SEQ ID NO: 228720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcaggatggtactgtagcgttaaggcggcg

SEQ ID NO: 228721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcaggtgctagaatgcagtcccggctgtag

SEQ ID NO: 228722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcaggtgggtgggcttaacgaagtacggta

SEQ ID NO: 228723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcaggttagcagatttccttacaattataa

SEQ ID NO: 228724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcatctcgcttagctcagtgctgaatttgg

SEQ ID NO: 228725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcatgtgtacgctatgccatgtccatacaa

SEQ ID NO: 228726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcattagggttcggtttaacggcactaatc

SEQ ID NO: 228727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcattgattacacttactcgagcttgggga

SEQ ID NO: 228728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggccaagtccaagttgccttcgtcgtgcccc

SEQ ID NO: 228729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggccacgccatgatctatcgtgttattttga

SEQ ID NO: 228730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggccataagccttttgacctgtgtcttgatt

SEQ ID NO: 228731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggccatcccaggattaggtgggatacggaca

SEQ ID NO: 228732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggccccttgcatttgattttcgagtggttct

SEQ ID NO: 228733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggccgaagcgcgtatgctcgtttctagtggc

SEQ ID NO: 228734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggccgaattgttatcgtcgttcaccaaggtg

SEQ ID NO: 228735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcgaggctggtctatcatgagggaggtacg

SEQ ID NO: 228736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcgcagacagatagtcacagtggcagggtc

SEQ ID NO: 228737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcgcgagtttcagccgctcagaaatagtcg

SEQ ID NO: 228738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcgcggtagagtatgtctccagtgaacgat

SEQ ID NO: 228739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcgctttgctttttccttcatatatggtcg

SEQ ID NO: 228740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcggagatgtagaatcgacttggcccagat

SEQ ID NO: 228741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcggatcaaaactttggtattcctagcctg

SEQ ID NO: 228742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcggggagggtcaggcagtggcgctattgc

SEQ ID NO: 228743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcgggttgggacccgatatgtgttccactc

SEQ ID NO: 228744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcggtgtgtgatctttctcccacctcattg

SEQ ID NO: 228745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcggttgcgatgtcgaagccgcgtgactgc

SEQ ID NO: 228746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcgtaggaagttcgagttagacccgttgcg

SEQ ID NO: 228747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcgtgcaccatcgtcgagattggcaatttc

SEQ ID NO: 228748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcgtgcttgacatccctcagcctcggttgc

SEQ ID NO: 228749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcgtggcaagactgcgcctggtgttcggtt

SEQ ID NO: 228750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcgttgaaacaggcatttggtttaatgtgg

SEQ ID NO: 228751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggctaagacgtgcctcaccagtccatccggt

SEQ ID NO: 228752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggctaagcttgtttgagttagatgttttacc

SEQ ID NO: 228753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggctacttttagggtcccattttgatatttt

SEQ ID NO: 228754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggctagactaatccgtgtgtatgctctgcta

SEQ ID NO: 228755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggctcaatctctagacacgagggcgtttcat

SEQ ID NO: 228756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggctcaccttgcctgcacctttttgtaaccc

SEQ ID NO: 228757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggctcacggtacttacatcattcaactcggt

SEQ ID NO: 228758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggctcattcacttcaaattgtgcgattcgaa

SEQ ID NO: 228759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggctcattggttgggcgactggcttgaatgg

SEQ ID NO: 228760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggctccgttgtatgcggattgcgacgatcgc

SEQ ID NO: 228761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggctctggtgatggcacagtccacacaggtg

SEQ ID NO: 228762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggctgaattctgtatgtacttggtatttgta

SEQ ID NO: 228763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggctggagggaacactggtttgctggcatcc

SEQ ID NO: 228764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggctggtttatctcacccactccctcgtgcg

SEQ ID NO: 228765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggcttgggtgtttcttcctacatagaaagta

SEQ ID NO: 228766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggctttctatgcctcacgacattttgcatgc

SEQ ID NO: 228767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggctttgccgttgccggtgttgacgctatac

SEQ ID NO: 228768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggaaacctggcttcaaatgtttgcagacat

SEQ ID NO: 228769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggaaactattaccgttattgctgtaaatac

SEQ ID NO: 228770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggaacattcttccaggtaattaagttatcg

SEQ ID NO: 228771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggaagaatatctgcaatgctcggcacttcg

SEQ ID NO: 228772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggaagagtgactcttttacttaactggtca

SEQ ID NO: 228773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggaagtcaaggctcccgtttgcacttagtg

SEQ ID NO: 228774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggaatgagcgtcttgacatcacaatgtatg

SEQ ID NO: 228775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggacctgagagcacattaaattctgggttg

SEQ ID NO: 228776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggactatcaggggatataaacatgggaagt

SEQ ID NO: 228777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggagcccgacagttggaccgctggtactac

SEQ ID NO: 228778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggaggaaactctgaatgtagacttatatcg

SEQ ID NO: 228779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggaggcgggaagtcaaccgtttccgtggaa

SEQ ID NO: 228780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggagggcatatgctggacacgctcacatag

SEQ ID NO: 228781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggagtagattgaggtaaaacactggggtta

SEQ ID NO: 228782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggagtccgaataagtcccagcattgggttt

SEQ ID NO: 228783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggatatctattctctatgaatgttttggac

SEQ ID NO: 228784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggatatttaggagtggggcccgggagtgcc

SEQ ID NO: 228785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggcaaataattgtgcgcaactcctggcgca

SEQ ID NO: 228786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggcactcgcgcgtagtttatcggttgggtc

SEQ ID NO: 228787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggcagatgcgtggagtgggagagctcggcg

SEQ ID NO: 228788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggcaggaacgttaactttcccctacttact

SEQ ID NO: 228789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggcagttggactgacaccggacgggcgttt

SEQ ID NO: 228790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggcatcatatgtagaggaaccccggttctc

SEQ ID NO: 228791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggccaaaatgggtgagcaggtgctcagcgc

SEQ ID NO: 228792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggcccggaaaatcgtatttttgtccgacgt

SEQ ID NO: 228793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggccctgtaggcttgtcgcattgggctagg

SEQ ID NO: 228794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggcctcgaattcatgagcgaacatagcgcg

SEQ ID NO: 228795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggcggggatagtacagggatcaaggccgag

SEQ ID NO: 228796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggcggggccacacacgagataaccagggta

SEQ ID NO: 228797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggcggtagagtaggtctcggcctattatgg

SEQ ID NO: 228798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggcggtcgttctgtggtggactctggttgc

SEQ ID NO: 228799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggcgtgacgtcttgtttaaatgcagggtta

SEQ ID NO: 228800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggcgtgatttgagttgctgagtgtggtaga

SEQ ID NO: 228801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggcgttaaagagtaaatcatttgctcgcgg

SEQ ID NO: 228802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggctactagtctgcggccgttgttgttccc

SEQ ID NO: 228803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggctatcggttttaggcagtcagacaacac

SEQ ID NO: 228804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggctcaagttcccattttgtcttcacgtgg

SEQ ID NO: 228805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggctgccctgctgtgtccgtaagtacatag

SEQ ID NO: 228806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggctgtcaacgtaagcgaagaagttcgtca

SEQ ID NO: 228807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggcttttacattattttttgtaacgcatgt

SEQ ID NO: 228808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggggaacgctataggagtaatgacttgatgt

SEQ ID NO: 228809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggggaatgatgagaatgtaatatattcggct

SEQ ID NO: 228810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggggactgatcagcacggtaccatgcggtgg

SEQ ID NO: 228811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggggactgctctcttggtttctcattgcggc

SEQ ID NO: 228812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggggagggcgacttcggttatctcgatagct

SEQ ID NO: 228813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggggatcttgctacttccaactttcccagac

SEQ ID NO: 228814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggggattcggtagataggaagcagtttccga

SEQ ID NO: 228815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggggcactcgcatgaggtcaaaaaactttcg

SEQ ID NO: 228816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggggcatgcgatatggttgatacgttaagta

SEQ ID NO: 228817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggggcattatctggtgactcttgcatggtta

SEQ ID NO: 228818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggggcggcatcctattatatgaacagccagc

SEQ ID NO: 228819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggggctgcgtggtatatcgggacaggcgtga

SEQ ID NO: 228820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggggaggcactctctgaaggggcagcatac

SEQ ID NO: 228821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggggatatgacggtggtcttcgagcaacgt

SEQ ID NO: 228822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggggcacgacacttgtgttatgttacggtt

SEQ ID NO: 228823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggggccaatgtgttgtacttagtctctatt

SEQ ID NO: 228824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggggtcttgcacgttaatacatccgggtat

SEQ ID NO: 228825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggggtactgaaaattgggtgtgctgcagggt

SEQ ID NO: 228826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggggtagctggcagctaatactgaggccggc

SEQ ID NO: 228827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggggtatgtgacgaggaattgggtcttgtgt

SEQ ID NO: 228828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggggtgcagggttaaagttcggccgctctcg

SEQ ID NO: 228829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggggtgttaatacagtagcgggcgggcacac

SEQ ID NO: 228830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggggttcaatttttaagcaatgttcagcagg

SEQ ID NO: 228831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggtaacaccgccctttcgattatattgaat

SEQ ID NO: 228832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggtaccattgtgcaatggacgccttaacgt

SEQ ID NO: 228833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggtagatctatgtgacaatatctttatctc

SEQ ID NO: 228834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggtaggggtggaggtcctagcttcatttcc

SEQ ID NO: 228835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggtcaaccggctcgttatggactaatcatg

SEQ ID NO: 228836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggtcaacgtcgtaatcccgaatctggtcgt

SEQ ID NO: 228837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggtcaatcatccttcatttacatgaacgca

SEQ ID NO: 228838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggtgcagaggtgatgcggtgctgagagtct

SEQ ID NO: 228839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggtgcgactctatacgggtacgtgtgcccg

SEQ ID NO: 228840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggtgcgctgaacccgtgaaaacttgactcc

SEQ ID NO: 228841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggtgggcggcttcgagcgctgagttttgtt

SEQ ID NO: 228842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggtggtgcaaaggggagcggctgttctccg

SEQ ID NO: 228843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggtgtcgtccgggagccacgcatcgcgcgt

SEQ ID NO: 228844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggttacctatgggtttagtttcccttgctt

SEQ ID NO: 228845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggttgtgttgcataaacgttcgttaactgt

SEQ ID NO: 228846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggttgtgtttccgagtccctgtccgagcta

SEQ ID NO: 228847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggtttaaagcttgactaacagcctccattt

SEQ ID NO: 228848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgggttttatacaaattcgtatgcctatttta

SEQ ID NO: 228849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtaaccctcagctctatattggacaaattg

SEQ ID NO: 228850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtaaggtcatttaacataccgccatatcta

SEQ ID NO: 228851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtaatgatttctggagcgccatgtccgggg

SEQ ID NO: 228852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtacccggggttgggcctccttctatacac

SEQ ID NO: 228853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtaccttttaccgtaactaaatttgtaatt

SEQ ID NO: 228854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtaccttttttcatttgtcccaaggcggat

SEQ ID NO: 228855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtactacaaaccttggttcttgccctgtcg

SEQ ID NO: 228856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtactattcatagattcgttttacgcgccg

SEQ ID NO: 228857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtagattaactgttttgtcgaaatatgttg

SEQ ID NO: 228858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtagcatttcatcatgtcggacgggcggct

SEQ ID NO: 228859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtagcttggttagcggtatggacattgtat

SEQ ID NO: 228860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtaggcaacctaattagaatggagtgccgg

SEQ ID NO: 228861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtagggtacgctcattgatagtccgtggga

SEQ ID NO: 228862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtaggtgatcctggcgctgatgagggagaa

SEQ ID NO: 228863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtataacgcagaaacgagcgcgtctacgtt

SEQ ID NO: 228864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtatcattgcagggactgatggagcacgat

SEQ ID NO: 228865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtatgacctggtcagttggccgtgccgcaa

SEQ ID NO: 228866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtatgcgtcaaacatgcttctggccaaggc

SEQ ID NO: 228867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtatttggattccgttcttcgcgtaacgta

SEQ ID NO: 228868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtcactccggccgaacattttaggtggtgc

SEQ ID NO: 228869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtcacttcatggctgggaaccaggtagtgg

SEQ ID NO: 228870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtccacttagcgcgcttcctcatccatgga

SEQ ID NO: 228871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtccccttattgacccgttgtcccatggcg

SEQ ID NO: 228872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtcccgactgcacagttacgggagatggaa

SEQ ID NO: 228873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtccgctcccctgttcaagattgggtattt

SEQ ID NO: 228874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtcctaattgtggcagtgtccgttgcaggc

SEQ ID NO: 228875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtccttaggaccggcattatttaccgggtg

SEQ ID NO: 228876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtcggcattgaggtgagccatgcaataccg

SEQ ID NO: 228877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtcttggttaactgtttgtttgcagcacca

SEQ ID NO: 228878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtgactgcctgcatagggggcttagcgcta

SEQ ID NO: 228879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtgatactcgcttccatgccaaagtttcgt

SEQ ID NO: 228880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtgcaccgtggtttattaccacaccggaat

SEQ ID NO: 228881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtgccgggtggttctacgttgagtcagtat

SEQ ID NO: 228882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtggctgaagaggtacctgctcctctggat

SEQ ID NO: 228883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtggggttgccatctcattggtaatcaatc

SEQ ID NO: 228884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtgggtctgcgcaagttgccggccgtaact

SEQ ID NO: 228885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtggtttattttaaccgttatttgcggtta

SEQ ID NO: 228886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtgtatctaccgctttctgaatcgcattgt

SEQ ID NO: 228887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtgtcccgcccgggattgtatttgcaacct

SEQ ID NO: 228888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtgtcgatccaagaaaggatccattttaga

SEQ ID NO: 228889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtgttccctaggtttggtttgtttacttcc

SEQ ID NO: 228890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtgtttgacagttttctatgacggtaattg

SEQ ID NO: 228891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggttaaatatgtttcagaatctgcgtgacaa

SEQ ID NO: 228892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggttaacgcgagttggtagttccctgccggc

SEQ ID NO: 228893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggttaagatgtgccggtcatcatgcgggtat

SEQ ID NO: 228894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggttaatggcatggttcgtatcgggcgatgg

SEQ ID NO: 228895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggttacaatcggtcatggcctcccgcagtct

SEQ ID NO: 228896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggttactcgccggtatcatataacggcaaag

SEQ ID NO: 228897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggttaggtgttgccttctctcaaaacacggt

SEQ ID NO: 228898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggttataagggctgtcattcgtgctctgtcc

SEQ ID NO: 228899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggttcgcgcaaagtattaaagtgatcgcgct

SEQ ID NO: 228900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggttctccgcgaacgtctcttgtactccagg

SEQ ID NO: 228901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggttgcaacatgtagcaattgaggtctagtt

SEQ ID NO: 228902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggttgtgagcagatacgtggggtttggcagg

SEQ ID NO: 228903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggttgttctacccacttcacgtaccatttgc

SEQ ID NO: 228904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtttatgggcaagctgtttatccgcgatgt

SEQ ID NO: 228905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtttgattgccctcgagtatcgttattctc

SEQ ID NO: 228906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggttttgatgtgtggagccgactctctaaac

SEQ ID NO: 228907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tggtttttttgggttatgccccttattctaac

SEQ ID NO: 228908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaaacttctgttgtcatgaaatttgattgc

SEQ ID NO: 228909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaaagaaccacatagcgtagttctactcat

SEQ ID NO: 228910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaaagaggagagtttcatgtacgcataccg

SEQ ID NO: 228911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaaagcaggggttactctagttgtgggacg

SEQ ID NO: 228912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaaatgtcgttgttttgccctaaaattccc

SEQ ID NO: 228913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaaattctttccttcggtaattcagctttg

SEQ ID NO: 228914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaacctcgtcggcttcccgtatatccaatt

SEQ ID NO: 228915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaaccttaattttcattcgcaagtagtgtg

SEQ ID NO: 228916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaacggattccacaaggtcctgctgtagtg

SEQ ID NO: 228917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaactacgggtgcgcgttatcttctggcga

SEQ ID NO: 228918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaagaaagtccccagctactaaccggatgc

SEQ ID NO: 228919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaagacccgtgtgcccctcgtaggtctatt

SEQ ID NO: 228920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaagctccagcgggtggaacatccggcatc

SEQ ID NO: 228921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaagcttttgatcattccgcggattctggt

SEQ ID NO: 228922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaagttccgttttatggtagtgtttcatgc

SEQ ID NO: 228923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaataacaatctcgaattggtatcggcggg

SEQ ID NO: 228924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaattatgttgtgcctaattgaccaagccc

SEQ ID NO: 228925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaatttataaatttgatgttttgggaaatc

SEQ ID NO: 228926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtacaatcacggcgggcagtcacttaaaggg

SEQ ID NO: 228927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtacaccgcgatttgacgtcactatgcgcgt

SEQ ID NO: 228928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtacacggacggaggcctgccgagattgcgg

SEQ ID NO: 228929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtacagaggcgggctgtggcaagtagatccc

SEQ ID NO: 228930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtacatatcttaagtgtcgtggcggcggctt

SEQ ID NO: 228931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtacatgccatgcaactaacaattttagtag

SEQ ID NO: 228932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaccaatttcgttcgcacagtctcttcttg

SEQ ID NO: 228933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtacccaggctacggcatgaaggcggttcct

SEQ ID NO: 228934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtacccgcgaaaaatccatcactgtgggatg

SEQ ID NO: 228935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaccgcagtaggctgttcagagtacaggac

SEQ ID NO: 228936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaccgctattcattcagcgtctttttggcg

SEQ ID NO: 228937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaccggcgcaacacgactctgggtgtttac

SEQ ID NO: 228938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaccgggtctcagactgcttaccaattggt

SEQ ID NO: 228939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtacctcggggcggcaatggtctagacacca

SEQ ID NO: 228940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtacctgccacacacatcatccggccgccgc

SEQ ID NO: 228941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtacgaaagtgatatagcatgcacactggtt

SEQ ID NO: 228942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtacgacccagcggcattcttatacgactac

SEQ ID NO: 228943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtacggcgcaaggtagtataggaggactaca

SEQ ID NO: 228944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtactactcggatcatcaagaagcttccgag

SEQ ID NO: 228945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtactctgaaagatctattcagcgacacctc

SEQ ID NO: 228946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtacttcataagcgatgattattttctaggg

SEQ ID NO: 228947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtactttatcttctgccagacttttaatgcc

SEQ ID NO: 228948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtagacgttggatccagtagatctatgaggt

SEQ ID NO: 228949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtagcggagaaagcccgtggcattgcactac

SEQ ID NO: 228950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtagctagggtcatataaccaagccttaacg

SEQ ID NO: 228951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtagctggtgacgtgatatcaaccagacacg

SEQ ID NO: 228952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaggaataggggagtctggatatatgccgg

SEQ ID NO: 228953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaggacacgtaaggaaatctgggactgtgc

SEQ ID NO: 228954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaggattagtgttactgacattactatcta

SEQ ID NO: 228955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaggattcatattatgtcataaagtatgtc

SEQ ID NO: 228956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaggcaccaatgaattcattgctttctggt

SEQ ID NO: 228957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaggcagtgggattacctgggactgttcac

SEQ ID NO: 228958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtaggcgcccattgatctgtattgaaacgtg

SEQ ID NO: 228959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtagtcgtagcttgtttgtaggtgggggcct

SEQ ID NO: 228960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtagtgtaaacaagagttacacagagtcgcc

SEQ ID NO: 228961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtagttattgcgggcaccttactaaactccg

SEQ ID NO: 228962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtatatatattagcatgggtgaaagcaaaat

SEQ ID NO: 228963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtatatcctcagcacttttgtgagacctatt

SEQ ID NO: 228964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtatcacacgatttaggttttgaatatttgt

SEQ ID NO: 228965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtatccagcttggttgtgtcttagaggcgaa

SEQ ID NO: 228966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtatccgaaatttacgctcttgctgcacttg

SEQ ID NO: 228967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtatccgccgagtgatcttcttgaggtggaa

SEQ ID NO: 228968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtatctagctattgacaagctccactcagga

SEQ ID NO: 228969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtatctagctgttagtccacacacgcagtca

SEQ ID NO: 228970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtatcttgaaacgggtaaaacgctgtagcac

SEQ ID NO: 228971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtatgccacgccagaattgacttcgtttata

SEQ ID NO: 228972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtatgcggctgctgttaagtcatccacaccg

SEQ ID NO: 228973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtatgctcaactcacacatctaaacactcgt

SEQ ID NO: 228974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtatgggtagtccccgcaacggccttggggt

SEQ ID NO: 228975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtatggtcgctactaaggagattttaatgag

SEQ ID NO: 228976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtatgtcggcgctattaagatattgacatgt

SEQ ID NO: 228977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtattaactattgctggacgagctgtcagtc

SEQ ID NO: 228978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtattatcttgtgaacggatgtcgtctgcgc

SEQ ID NO: 228979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtattcaacgcgctacaataaatacccataa

SEQ ID NO: 228980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtattgcaacacactggatggcgtacgccgt

SEQ ID NO: 228981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtatttagtgtagctaattggtgcggtaagg

SEQ ID NO: 228982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtatttcagggtctgctgtgggaatggtgtc

SEQ ID NO: 228983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtatttgagtgtacaacgatgacgttcttga

SEQ ID NO: 228984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtattttctggaaagctagtaactgcttgat

SEQ ID NO: 228985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtatttttcatgaacggacggtagtgggcta

SEQ ID NO: 228986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcaaaatttgtccgatatttcgctaaatca

SEQ ID NO: 228987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcaaatgcgatgtatcattgcggactggcg

SEQ ID NO: 228988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcaatattcgatacctcgaactatatatga

SEQ ID NO: 228989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcaatgtgttctttctaaatgtcttcgtgc

SEQ ID NO: 228990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcaattcattaagtttagtatggagttcgc

SEQ ID NO: 228991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcacaatcattgaacagcaggccccggttc

SEQ ID NO: 228992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcacttgcgaaagcgtgttcagtgatgcac

SEQ ID NO: 228993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcagaacgctgaaaggttggactctctttc

SEQ ID NO: 228994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcagcctgggagatgtaaacaataccgata

SEQ ID NO: 228995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcagcgacattcagtccccagctggggcat

SEQ ID NO: 228996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcagcgctacacactcgaggttttctagta

SEQ ID NO: 228997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcagggtattcgaggagtattggcgttctc

SEQ ID NO: 228998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcaggtgccggacttatcccagttggtggc

SEQ ID NO: 228999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcaggttagtcaccattcgatcaaaccatt

SEQ ID NO: 229000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcagtccttctcgctacctgcccgcttgtt

SEQ ID NO: 229001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcagtctgttttagtctcaaagttaaagat

SEQ ID NO: 229002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcagttcacgtctactccggacttccagcc

SEQ ID NO: 229003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcataagtagtccttatgtagcttaggcaa

SEQ ID NO: 229004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcatgcgaggccagaaataactaacttcaa

SEQ ID NO: 229005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcatggctagaaatgaacttcgagcgcgcg

SEQ ID NO: 229006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcatttagccttggttgtggcactgaagca

SEQ ID NO: 229007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtccagatgtgtgatagggaattaagatgct

SEQ ID NO: 229008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtccataatacccgttaacacagctataagc

SEQ ID NO: 229009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtccatagtgttagctctcgggggcaggcta

SEQ ID NO: 229010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtccatcgggtacctcgcgcttttattgtat

SEQ ID NO: 229011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcccagaccatcagcggcttcatccggttt

SEQ ID NO: 229012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcccagggccgatacaccaccagctcaatt

SEQ ID NO: 229013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcccatgcatgaccccatcaaaatggcctt

SEQ ID NO: 229014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcccgaagtgtaacatctccccgaggtttc

SEQ ID NO: 229015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcccgacacggataaaattcttttccatgt

SEQ ID NO: 229016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcccgatcgctgagtggcgtcgatcttagc

SEQ ID NO: 229017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcccgcaattttgctaaggactctgaatct

SEQ ID NO: 229018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtccctaccgtccttgccgaccctgagaatg

SEQ ID NO: 229019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtccctgtccgccagttcataatttcgactt

SEQ ID NO: 229020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtccgaaatggagcttacggcgcatctatgg

SEQ ID NO: 229021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtccgcgtacgggttctggtcgtctagtcga

SEQ ID NO: 229022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtccgctacccagtttccatgcttcatactg

SEQ ID NO: 229023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtccgcttccatgccacttaagagtagtaac

SEQ ID NO: 229024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtccgttgggggaggcgtgttagcgttgggg

SEQ ID NO: 229025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcctcgtcgacctttttctcgggggcaggg

SEQ ID NO: 229026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtccttgtttccggggtgtgtcattaacagc

SEQ ID NO: 229027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcgaagcgataatagaaagtgggaacggtg

SEQ ID NO: 229028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcgaggacggctggcatactctcatgcttt

SEQ ID NO: 229029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcgagtcactataaacgcggctaggtattg

SEQ ID NO: 229030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcgagtggtaaccttagctagtatcgtcga

SEQ ID NO: 229031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcgatgatgacacctactccttggtaacga

SEQ ID NO: 229032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcgcaattgaaccgtctacggccgtacgag

SEQ ID NO: 229033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcgcatcatctcccgatgcatgccgcaagt

SEQ ID NO: 229034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcgcgttttaagatcacagtccggaggtcg

SEQ ID NO: 229035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcggacatgttaacaatctcccaatctgga

SEQ ID NO: 229036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcggacccttctatccgatcactaaacacc

SEQ ID NO: 229037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcgggctatcttagaggaagtatagggtcc

SEQ ID NO: 229038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcggtgcgtttaaacgatattataaggtga

SEQ ID NO: 229039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcgtaaaaggtttaaggttctcgaggttca

SEQ ID NO: 229040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcgtacgtggggtttggtagttctctattt

SEQ ID NO: 229041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtctaatgtatcctataaatcttttaagcgt

SEQ ID NO: 229042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtctagcagtgcactagagactcgagacatc

SEQ ID NO: 229043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtctcgtatatccgcactcggtctgcgagag

SEQ ID NO: 229044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtctctcttcccacatctgttgccctcgcga

SEQ ID NO: 229045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtctgaatcgtccttggaatacactcttgtg

SEQ ID NO: 229046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtctgatatagcttccaaagacttagtctag

SEQ ID NO: 229047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtctggaagcctggagacatgagcctttctc

SEQ ID NO: 229048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtctggccgtgttagagcaatattcggtttg

SEQ ID NO: 229049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcttatgctttaaagtaactaaatcactgc

SEQ ID NO: 229050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcttgttatctctaccgttgttgggctcaa

SEQ ID NO: 229051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtctttacctgcgtgtctgcttgccttcgac

SEQ ID NO: 229052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtctttcaacacatggggcctacctttcact

SEQ ID NO: 229053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtctttctaatgcggagacttaccttactcg

SEQ ID NO: 229054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtcttttaagtaggctttctataccttatgt

SEQ ID NO: 229055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtctttttcctaacaaccggaacctactttc

SEQ ID NO: 229056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgaaacctagctcggtgattacacatgcat

SEQ ID NO: 229057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgaaatcgcctcatctgacttagggatagt

SEQ ID NO: 229058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgaacgtgtcgtaaacgcattcgtcgggga

SEQ ID NO: 229059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgaatcaggtcttcggtcaggtaggtatcg

SEQ ID NO: 229060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgaattcggcggggagcgacactgtgggag

SEQ ID NO: 229061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgacaaggccgcggttatacgctatcgggc

SEQ ID NO: 229062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgacattgtatagcgcgtcgattgtaacgg

SEQ ID NO: 229063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgaccgtatgggtatcgtttccttgtcccg

SEQ ID NO: 229064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgagacagggtactactggtgcgctgtgtg

SEQ ID NO: 229065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgagagcatcaattctcattctccaccatc

SEQ ID NO: 229066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgagatcgccgtaattgtgccagcaacatc

SEQ ID NO: 229067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgagctcgatgttagtatccgtggcaatgg

SEQ ID NO: 229068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgagcttcaaatcgactcagtctgtgtata

SEQ ID NO: 229069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgaggagccttcctgaatgtttacgagggg

SEQ ID NO: 229070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgaggggagagctctgtcgacctttcccgg

SEQ ID NO: 229071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgataactcatggagatgcggtacccgatg

SEQ ID NO: 229072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgatgatcttattgattcgactgtgttgat

SEQ ID NO: 229073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgatgttaaggtctcggtttagaaggagag

SEQ ID NO: 229074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgattaagggggacactgagtggtttttac

SEQ ID NO: 229075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgattagaaaatagcatttttgcggcctcg

SEQ ID NO: 229076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgcaaacggccacccgctacttgtgtggga

SEQ ID NO: 229077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgcaccgggacacagattgaatggcgatcc

SEQ ID NO: 229078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgcacgtaggttcatacgtgaaatacgcga

SEQ ID NO: 229079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgcagcacaggggtcttcggttcattagga

SEQ ID NO: 229080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgcagtgctctcaattctgacccgggcccg

SEQ ID NO: 229081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgcatttgctgtaaatggtcacaagactgt

SEQ ID NO: 229082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgccatcgagagctcctggatcggtgggct

SEQ ID NO: 229083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgccattgaattcttaatcgagccgaatgc

SEQ ID NO: 229084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgcccttgtctcgacaacgttctaaatcta

SEQ ID NO: 229085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgccgcttggattagctgtttattgcttcg

SEQ ID NO: 229086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgccggcatctagctccatctgaagaggtg

SEQ ID NO: 229087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgcctaagcaccaattacggatgagggttc

SEQ ID NO: 229088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgcgaacgctacgtaatccacccaatttgt

SEQ ID NO: 229089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgctactgttaagtaacgactatgcatcca

SEQ ID NO: 229090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgctatgcgctttcggactactactgcttc

SEQ ID NO: 229091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgctcgtccgagtgttgtccatgttagagt

SEQ ID NO: 229092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgctggactctgaatgttgattgccgtagg

SEQ ID NO: 229093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgctgggttaaaggtcatgaggcgtctccc

SEQ ID NO: 229094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgcttaaaacaggaacgcttggtttgtacc

SEQ ID NO: 229095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgcttctctaagcagaggggttaaagacac

SEQ ID NO: 229096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgcttggtccacagcattattggagacttt

SEQ ID NO: 229097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtggaacaagtaaacggttttctgcgtcgtt

SEQ ID NO: 229098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtggacctggtgtgattgcacccggcaggag

SEQ ID NO: 229099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtggactctgttgatatcgcagtggtattcc

SEQ ID NO: 229100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtggatagttgtctcgatatgctacaactgc

SEQ ID NO: 229101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtggattcgagtttgcccggggctaaacact

SEQ ID NO: 229102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtggcaattacacgtcttggtcccttcttac

SEQ ID NO: 229103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtggcacccctcaccagtgcttggtcctcac

SEQ ID NO: 229104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgggagctgtaggggtattttttgtatcgt

SEQ ID NO: 229105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgggcaacaatttccatatgccggatttgt

SEQ ID NO: 229106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgggccgatccattcggttgactattgagg

SEQ ID NO: 229107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgggctcgattctttaaggtgccctcggga

SEQ ID NO: 229108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtggggccacgttggtggggaatttacgcgg

SEQ ID NO: 229109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgggggcaacgcaaccttgtattaaaccat

SEQ ID NO: 229110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgggtcaacgccaatttgttacttgatccg

SEQ ID NO: 229111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgggtggactcagctggctcttgcggtacc

SEQ ID NO: 229112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtggtaccgtcatttttggagtgctcgctgc

SEQ ID NO: 229113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtggtagtaaggtatccgtgatgtcccccta

SEQ ID NO: 229114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtggtcagatggtgtcccctacgatgcggtt

SEQ ID NO: 229115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtggtcctgtggaatgcacaatggcgtggtg

SEQ ID NO: 229116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtggtggtttctgacgatgggtgtgcatgtc

SEQ ID NO: 229117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtggtttggttccgagatataggtgattttt

SEQ ID NO: 229118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgtaaatgtcatcggtttaggtctttgtgc

SEQ ID NO: 229119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgtacaaggcggccacaggtctgtggttgg

SEQ ID NO: 229120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgtactccatcgttgaggtttatcttgtcg

SEQ ID NO: 229121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgtataggtccatattggtcgacagggagc

SEQ ID NO: 229122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgtcactggttgttgggcgaaggttggaca

SEQ ID NO: 229123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgtcccagctcaacttgcccctgctaagcc

SEQ ID NO: 229124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgtcgcggggggaataatgcgcaaagtgcg

SEQ ID NO: 229125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgtctcccgctgtggtgtacgtccgctaag

SEQ ID NO: 229126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgtgcctcaagccctgtgtttcactccact

SEQ ID NO: 229127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgtgcctgggcaaatcactcttattattct

SEQ ID NO: 229128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgtgcggccaccggtctgtgttgacttcac

SEQ ID NO: 229129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgtggaagtgtaaaagtacttagcttcact

SEQ ID NO: 229130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgttaacaagcccactgacaagattcaggt

SEQ ID NO: 229131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgttaactggcaacaaaattactcgaccat

SEQ ID NO: 229132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgttaaggcgtggggtttcgttgtacctcg

SEQ ID NO: 229133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgttaataggcatggccgttgcggaggggt

SEQ ID NO: 229134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgttcatcaccttatttcacaaatacacac

SEQ ID NO: 229135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgttcctaatgttcactaacttctattttc

SEQ ID NO: 229136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgttgctgtacgcttctttatgtggattat

SEQ ID NO: 229137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgtttatcggctttcttggatgtatccaat

SEQ ID NO: 229138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgttttcaaataggttgataggattaagta

SEQ ID NO: 229139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtgttttcaatgccgggatgccgggatatgc

SEQ ID NO: 229140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttaacgaatggttgtaggccatatggtcat

SEQ ID NO: 229141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttaagtgggacggcgggggtaatgaatgtt

SEQ ID NO: 229142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttaattcgcggttcatcacggaggttaata

SEQ ID NO: 229143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttacaacagttaatttggttctgaattagc

SEQ ID NO: 229144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttacccacgagagacaacgcgtgcacggtc

SEQ ID NO: 229145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttacctgtacacaagatacgctggggactt

SEQ ID NO: 229146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttactacggcccagggacgtttttattttg

SEQ ID NO: 229147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttacttgggttctggaggtaatcgacctgg

SEQ ID NO: 229148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttagattttaagcttgactcaagacgtgcg

SEQ ID NO: 229149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttaggggtttggctcgtatgatcatcggct

SEQ ID NO: 229150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttaggttagatctttaattagccgatatgt

SEQ ID NO: 229151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttagtcctgcgttctgtacaaggcgggttg

SEQ ID NO: 229152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttataggcaatcttcagttgagacgagtcc

SEQ ID NO: 229153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttatcaactccctgcaaatatgtgtgaaac

SEQ ID NO: 229154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttatcgctaatgctctgttcccgcccgggg

SEQ ID NO: 229155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttatcttgtcgctgtgcgcaaggggcccat

SEQ ID NO: 229156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttatggcatattaacttccttgaacgcggg

SEQ ID NO: 229157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttatgtccgatcagtcgcttttggaccgga

SEQ ID NO: 229158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttatgtctattttcagtggcgcatgttacc

SEQ ID NO: 229159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttattcaaacgctcttccagtcatgtgggc

SEQ ID NO: 229160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttatttcctatgtagttaaccctgccctct

SEQ ID NO: 229161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttcaaacggtcgacggtgggtagtacttta

SEQ ID NO: 229162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttcactaacgcataggtctctctaatcatg

SEQ ID NO: 229163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttcactcgcgaagttgcactaacatttgga

SEQ ID NO: 229164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttcactctcctattgggctctcaactgttt

SEQ ID NO: 229165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttcagatatttgtgcattgagtatcacagc

SEQ ID NO: 229166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttcagcttcatgatatagtgcaggaggtta

SEQ ID NO: 229167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttcagttctactcctacgcattaggcttct

SEQ ID NO: 229168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttcagttgaggtgtctcgttagcctgttgg

SEQ ID NO: 229169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttcagttgctaaatgtatcttgaacagtag

SEQ ID NO: 229170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttcatgacggtctagcacctatgatgatga

SEQ ID NO: 229171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttcatgcccgaccaaaactggtgatctgac

SEQ ID NO: 229172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttcattatgtgcagcccaagcattctcttc

SEQ ID NO: 229173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttcatttcctcctcatgttatctctgttca

SEQ ID NO: 229174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttccagcaattccggtcattcagaggctag

SEQ ID NO: 229175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttccataactcgaggttaatgtgctgaact

SEQ ID NO: 229176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttccatatgacggctctactaaatctggtg

SEQ ID NO: 229177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttccatttaattgttaaaagtgtgaatagt

SEQ ID NO: 229178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttcccagagggcccagaaatacagataggc

SEQ ID NO: 229179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttccccaggcatcttcctaacggtgtggag

SEQ ID NO: 229180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttcccgttgtaagcacggtacgaatggaac

SEQ ID NO: 229181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttccctctctggtttttcgtctcgtatatc

SEQ ID NO: 229182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttcgatccggcgtttcatagatggctcgct

SEQ ID NO: 229183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttcggacgtgtccgaggatttaagtcttac

SEQ ID NO: 229184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttcggccgcgcagatcttggggaggctcgg

SEQ ID NO: 229185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttcgttcttatgctgatacgtcgcgccaat

SEQ ID NO: 229186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttctattgagcaacgcgggatttcccgtcg

SEQ ID NO: 229187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttctgacctggcgactgtgggttccatcta

SEQ ID NO: 229188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttctgcatatccacgggctgtaagtgcgtt

SEQ ID NO: 229189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttgaaagacttaatttcagctctcgatgag

SEQ ID NO: 229190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttgacattacctcctgggggcccaaattta

SEQ ID NO: 229191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttgagctaacttattaacgcccaaaggtta

SEQ ID NO: 229192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttgattccgcacaaaacgatttaatttgca

SEQ ID NO: 229193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttgcactcatcgacatctgtgatatttgtt

SEQ ID NO: 229194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttgcattgcctcgcagtgagctatattgac

SEQ ID NO: 229195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttgcctctgatattatacggttctgtcctc

SEQ ID NO: 229196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttgcctttattccgcggcgttctggggtga

SEQ ID NO: 229197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttgctaaaacaacgggtatcaatggactgt

SEQ ID NO: 229198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttggcacattactttacttaccgtggctaa

SEQ ID NO: 229199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttgggattcaagctaccccgtgggagactt

SEQ ID NO: 229200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttggggccataactcttcaccccataggga

SEQ ID NO: 229201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttggtatccgacgtttgacctagctgtcgg

SEQ ID NO: 229202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttggttggggtatgtgggttgctggtcccc

SEQ ID NO: 229203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttgtattcgtcattagcaccacatgacctt

SEQ ID NO: 229204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttgtcaagccggttggggttgcagcccttc

SEQ ID NO: 229205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttgtcaatcttttgtagttcattcagcact

SEQ ID NO: 229206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttgtgatcggtcatttccgaagcaagtggg

SEQ ID NO: 229207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttgtggttcccggggtccacttggctgatc

SEQ ID NO: 229208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttgtttaattggtgggttttatatatctta

SEQ ID NO: 229209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtttaaaactaggaaagggcggttggtacgg

SEQ ID NO: 229210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtttaccgggtcttcaagtttggtgaggttt

SEQ ID NO: 229211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtttaggtccacgcttatgtattgcactttg

SEQ ID NO: 229212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtttatcaggcgcgcttaagtgtgatcagtc

SEQ ID NO: 229213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtttatcggagagtggaatcgagcccctcta

SEQ ID NO: 229214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtttatcggattcggcaccgtattcactgca

SEQ ID NO: 229215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtttatgatgagggttggtccttctcggtca

SEQ ID NO: 229216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtttatgtacaattgctcacctccattctgg

SEQ ID NO: 229217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtttattagttcatgttttgtacggagctat

SEQ ID NO: 229218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtttcaagccaacaatattagtagtttagtc

SEQ ID NO: 229219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtttcaggtgtcgatttattattggatactt

SEQ ID NO: 229220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtttcagttaaccgggttcttttcgaatgtt

SEQ ID NO: 229221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtttcccatccattgcacggggtttaggacg

SEQ ID NO: 229222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtttcgaatgtgaattattattatccgacct

SEQ ID NO: 229223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtttgcacaggatatttcacatcagcccgct

SEQ ID NO: 229224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtttgcttgggccatctcctcgatattagta

SEQ ID NO: 229225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtttggttattcacctcgatatcgccacgcc

SEQ ID NO: 229226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttttaaactaggtgtaatttatgtttttat

SEQ ID NO: 229227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttttaatattcttctagtggtgtattcaag

SEQ ID NO: 229228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttttacgggctgtgtattttagggtatctg

SEQ ID NO: 229229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttttagcacactatcttaggcaaacagtcg

SEQ ID NO: 229230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttttagccgatcatttaatgcccgttcctg

SEQ ID NO: 229231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttttagttggtgtaaactcagaagaagagt

SEQ ID NO: 229232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttttctcctttctcaagggcgttcataggg

SEQ ID NO: 229233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttttctggcctcaaactccttggaatactc

SEQ ID NO: 229234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgttttgggcgggggataggaaggtcttctag

SEQ ID NO: 229235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtttttgatcacatgaatcaaggcgctctcg

SEQ ID NO: 229236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtttttttatagtattcgtactcggtgtaac

SEQ ID NO: 229237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgtttttttttagagcgatcgcttcggtcaag

SEQ ID NO: 229238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaaacatcatttctaaggatcttcggagct

SEQ ID NO: 229239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaaaggtatggttatccggctgatagttgt

SEQ ID NO: 229240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaacatttacgcggcatgtatatgatggcc

SEQ ID NO: 229241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaacggaggccaggaccggaacgagaactg

SEQ ID NO: 229242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaactcttgtgctagcttctttatatctac

SEQ ID NO: 229243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaactggcggaattatatcgacctataatc

SEQ ID NO: 229244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaacttcacgtccaacgtctcgtactcctc

SEQ ID NO: 229245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaagcccgtgttcccgtcttcacatggttc

SEQ ID NO: 229246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaagcgaaacactctcaactttacatttat

SEQ ID NO: 229247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaagcttcatcaaatgaagaatgggatatt

SEQ ID NO: 229248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaaggaatctttccatggcagaagtccata

SEQ ID NO: 229249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaagggtccgcatttgaaacgagaatcacc

SEQ ID NO: 229250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaaggtccggttgggtccgcgtgcaatgta

SEQ ID NO: 229251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaagttgccgtaagtcgaggggcgacgtgc

SEQ ID NO: 229252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaatagtaggcttcacgccagagtggaagt

SEQ ID NO: 229253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaatatcggttggggtaacattctgcgtgg

SEQ ID NO: 229254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaatcccttggattgttcttgtttcttttc

SEQ ID NO: 229255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaatctcctggaagcggatgttcatcaggt

SEQ ID NO: 229256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaatgcgatctcaaaaacggactgctttcc

SEQ ID NO: 229257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaatggtatgatgcttgtgctctagtgtag

SEQ ID NO: 229258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaatggttattacccgagttaccatttggg

SEQ ID NO: 229259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaatgtcagtgtggcgtaaggcggccagct

SEQ ID NO: 229260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaatgtcggacccgtcctttggtctttgat

SEQ ID NO: 229261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaacaagttgctagatgcatatatctgttgt

SEQ ID NO: 229262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaacacgggtatccacactcaacagttagtg

SEQ ID NO: 229263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaacagcttctggttgtatggaacggttttt

SEQ ID NO: 229264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaccaaaattcagtagctttatgttatctt

SEQ ID NO: 229265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaccactggccttctgcgtccttccttaga

SEQ ID NO: 229266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaccagctgattgcatgccctgtttctcac

SEQ ID NO: 229267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaccatgattgttgactccggtatcattcc

SEQ ID NO: 229268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaacccagtcgcacagctttgctcttgtctg

SEQ ID NO: 229269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaacccttacgcacattgttagagatgctgc

SEQ ID NO: 229270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaccgtgtaagggtaccaaatcccgattga

SEQ ID NO: 229271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaacctcatccactgactaattccgctcgtg

SEQ ID NO: 229272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaacctctcaaactcgcctcacgcgtacttg

SEQ ID NO: 229273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaacgaattgttcaatcgcgctgaagggcga

SEQ ID NO: 229274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaacgccaaatgtggtgctgtcttcctcgtc

SEQ ID NO: 229275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaacgctacaaaatcatttggtgaattgccc

SEQ ID NO: 229276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaacggcatcatatctcgaaattatcaattt

SEQ ID NO: 229277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaacggccaggacagcggatgtcgctaggca

SEQ ID NO: 229278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaacggggcttgctactctacctcttcaggt

SEQ ID NO: 229279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaacgggtctatccttcatcaggggcacttg

SEQ ID NO: 229280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaactaactagtgcttgataatcttcagacc

SEQ ID NO: 229281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaactgctaacttgttgctgattaggattac

SEQ ID NO: 229282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaactgcttattacttcttaccaggctggtt

SEQ ID NO: 229283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaactgttacgcatttttggtcgtggacaac

SEQ ID NO: 229284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaacttccccggtttcggttctttgagggcg

SEQ ID NO: 229285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaacttggtttctcccattggcagaagttag

SEQ ID NO: 229286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaacttttgcaaacgcaggattgatactcac

SEQ ID NO: 229287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaagaaccccctaggtttcctcttatacgtc

SEQ ID NO: 229288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaagaatatattggcacgcttcacgcgctct

SEQ ID NO: 229289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaagaatgggtatggaatttagccgcctgct

SEQ ID NO: 229290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaagacaaagccctggtctcacattcctcat

SEQ ID NO: 229291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaagacaacaagggcaggaacggttggcctc

SEQ ID NO: 229292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaagacttatttggagctcttcaacaccaca

SEQ ID NO: 229293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaagagatcatagagacctgagtcctcgata

SEQ ID NO: 229294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaagaggacttaatgttttcaggtatctcgt

SEQ ID NO: 229295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaagccaggcggcagtgcgataaacggtgcc

SEQ ID NO: 229296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaagcctttttatgaaagtcttaggtcgagg

SEQ ID NO: 229297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaagctaggtcagtggtcagctgtttgaatc

SEQ ID NO: 229298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaggaccaatgctggtgtgagctgttgcgt

SEQ ID NO: 229299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaggagtgggctctgtctgacaactcgatt

SEQ ID NO: 229300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaggattaaacactcagcgaatggctagcc

SEQ ID NO: 229301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaggattatcgcaactgtacggtgcgttgg

SEQ ID NO: 229302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaagggagtaataacgagtcacctgcgctac

SEQ ID NO: 229303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaagggcagcagacggtggggggtttttact

SEQ ID NO: 229304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaagggcttcgtctttatgttgttgcttttt

SEQ ID NO: 229305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaggtcacctggcttggtttaatagagaca

SEQ ID NO: 229306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaaggtgatgtaatatggcgcccgccctccg

SEQ ID NO: 229307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaagtactgaagcattatctgcagccccaac

SEQ ID NO: 229308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaagtattcagcatgcaaactaataacttca

SEQ ID NO: 229309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaagtgcacgtaccggggtaaacgaactaga

SEQ ID NO: 229310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaagtgccctactttactaacattcatgacc

SEQ ID NO: 229311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaagtgtgatttttgcaacaccttcgctctg

SEQ ID NO: 229312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaagttcctagttagttagttccgcgccttc

SEQ ID NO: 229313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaagtttcctgggtacatgttctcacatatt

SEQ ID NO: 229314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaataattcgatctacgacttcaccggaggt

SEQ ID NO: 229315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaataattgttcaggtgtccccgcagcccgc

SEQ ID NO: 229316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaatacgcttgtggaaggaaccccctatagg

SEQ ID NO: 229317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaatattggagcttgtcttacccgggccctt

SEQ ID NO: 229318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaatcaacgctcactggctgtaaattattcg

SEQ ID NO: 229319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaatcatgcttcttgagacaaagttgtttac

SEQ ID NO: 229320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaatcatggcaaaggggaccgtgggaatcgg

SEQ ID NO: 229321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaatcattcaacgaggggtgcgaggttccgc

SEQ ID NO: 229322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaatccacttcgcgatggtcacgacttcggg

SEQ ID NO: 229323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaatccggccacatccgatcaacacgtatcc

SEQ ID NO: 229324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaatctcttttcgatcctagactgaaggcca

SEQ ID NO: 229325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaatcttagtatgacttcgtgcttgatatta

SEQ ID NO: 229326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaatgaggatgccagtacattgagtatactc

SEQ ID NO: 229327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaatgcatctaaaccactacttttactcgac

SEQ ID NO: 229328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaatgccgccttaggtgtagtagcttattat

SEQ ID NO: 229329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaatgcctgtctacaacttttcctgttggtt

SEQ ID NO: 229330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaatggtttactcagctcttcaacttgcagc

SEQ ID NO: 229331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaatggtttcggaaggcctattaccttcatc

SEQ ID NO: 229332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaatgtctcgtgcgcacagtgatagtgttca

SEQ ID NO: 229333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaatgttggggtgattaagttataccgatga

SEQ ID NO: 229334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaatttcatatgcatcttaagaatgctgtcg

SEQ ID NO: 229335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaatttctacgacccgaatgtggctagggtt

SEQ ID NO: 229336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaatttttgattctgttgggttactccggat

SEQ ID NO: 229337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacaacaggttacgtcgctagcgagtatacc

SEQ ID NO: 229338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacaacgtgtaatgtaagtattggtttcggg

SEQ ID NO: 229339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacaactcgctgcggagactctttgcgctgt

SEQ ID NO: 229340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacaaggatcctctagcttttttctgactca

SEQ ID NO: 229341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacaagtctagcttacccgctctgccttgga

SEQ ID NO: 229342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacaattttatactcaccgtttattaggcgc

SEQ ID NO: 229343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacacaactccatccacatctcgagatacaa

SEQ ID NO: 229344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacacattcacctgattcaactaattagggt

SEQ ID NO: 229345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacaccccttcgattattccgttaagtcaca

SEQ ID NO: 229346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacacgactaatcgatctaaaggtgccggag

SEQ ID NO: 229347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacacgttcagtgtccgcgtgtccgcctaaa

SEQ ID NO: 229348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacactgcatttcgtgctgcagcttgtggca

SEQ ID NO: 229349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacactggtactccccctctggtctgatggc

SEQ ID NO: 229350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacactgtcgtttattagactctatcggggt

SEQ ID NO: 229351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacagaactttagggcatcacgttgtttggg

SEQ ID NO: 229352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacagcggactaagctaactatatggatgtg

SEQ ID NO: 229353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacagctaatcggaagccacaaggatcggtt

SEQ ID NO: 229354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacagtatgcattgcttaacagtatagaatt

SEQ ID NO: 229355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacagtgccccggacgactcttttgacgatc

SEQ ID NO: 229356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacatacgggctttctgcagtgcatgtgcca

SEQ ID NO: 229357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacatctcgcagacatatcctttgtgctcta

SEQ ID NO: 229358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacatgctacgtctctggtgtcctaagcgaa

SEQ ID NO: 229359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacatggcagttaggacactgagtagcgtcg

SEQ ID NO: 229360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacattagcctacttatcacgttcgaactta

SEQ ID NO: 229361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacattcctgaagtagattgtcgtagcgttc

SEQ ID NO: 229362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacatttagttgctcatacttgatgctgttc

SEQ ID NO: 229363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaccacacagtcagtccccgttaggatgcaa

SEQ ID NO: 229364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaccacgtggttcattattgcagttcgagct

SEQ ID NO: 229365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaccactttaatgtcaaactcaaaaacgtgc

SEQ ID NO: 229366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaccatcccggactttagatactcgaacaag

SEQ ID NO: 229367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaccatctaatgccctccaacttctgtgctt

SEQ ID NO: 229368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaccatgttttcacgttatttccagcagggg

SEQ ID NO: 229369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaccattttgacaaaacggtctgccgcttgc

SEQ ID NO: 229370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacccctatcagtcagtagcgaggtagtttc

SEQ ID NO: 229371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacccgcgcaaaatggatgcaggcgccaccc

SEQ ID NO: 229372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacccgcgtctgtattaaccgtcgtgtctta

SEQ ID NO: 229373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacccgctacgtccatacagatgtacggatc

SEQ ID NO: 229374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacccggcctcttacgcatctgcgtggctat

SEQ ID NO: 229375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaccctagcgtttgaaacggaatcgcgcatg

SEQ ID NO: 229376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaccctgttacgaagacatgtttttgttata

SEQ ID NO: 229377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacccttaaattcttcttcttggtattccac

SEQ ID NO: 229378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacccttgacgggaatacagatcgacagtct

SEQ ID NO: 229379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacctagtgggatgttcataaggacggctcg

SEQ ID NO: 229380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacctctttacttgccttgctgcaaaaccca

SEQ ID NO: 229381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacctgacgaccacttgggcgttttggatga

SEQ ID NO: 229382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacgaaatcgactaggtgtgctccagtctat

SEQ ID NO: 229383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacgaagacggatgcatgtatgtagcatgtt

SEQ ID NO: 229384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacgagtgttctttaatttacaggctgataa

SEQ ID NO: 229385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacgattacgccctcggccatgctataccgt

SEQ ID NO: 229386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacgcaacctttcggcgtccgcgctaacatc

SEQ ID NO: 229387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacgcaagcgttttagggttacgggggcagc

SEQ ID NO: 229388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacgctccgaccgcagagcgcagtgtcagtg

SEQ ID NO: 229389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacggaaactgtccttcccttgcccctactt

SEQ ID NO: 229390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacgggaaggggcgggatgtttggggtactc

SEQ ID NO: 229391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacgggcaattctcgttattgatatccggcg

SEQ ID NO: 229392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacggggatatcagcacatcatcctagtgac

SEQ ID NO: 229393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacgggtgtgcgataatacaagccgtctctc

SEQ ID NO: 229394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacggtaaagctagtcattcacgggccacac

SEQ ID NO: 229395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacggtaatgattataccaccgctcttgaga

SEQ ID NO: 229396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacggtccgtctcccgcaaacaacgaattta

SEQ ID NO: 229397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacggttgatctctacattggcacgtccgac

SEQ ID NO: 229398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacgtatgggatttcttcatgcacgatttag

SEQ ID NO: 229399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacgtcaccacttgcaatttcactttactta

SEQ ID NO: 229400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacgtctttccgttatgatttttagtacacg

SEQ ID NO: 229401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacgtgcttgaacacctacaacttagacgca

SEQ ID NO: 229402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacgttaacgtgtgcgccttagaccgactaa

SEQ ID NO: 229403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacgttccgccagcccattgatcgcaacgat

SEQ ID NO: 229404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttactacagactccggaaacctcccagatttg

SEQ ID NO: 229405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttactacattctctacctcttacatcagtgtt

SEQ ID NO: 229406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttactacgtattcaccgcatgatccctggttc

SEQ ID NO: 229407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttactatctcaggctctaggattctaaagtct

SEQ ID NO: 229408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttactattgtacttataatatttttattgctg

SEQ ID NO: 229409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttactcgacacgcgtctcgtgcgatttgatcg

SEQ ID NO: 229410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttactcgaggttcgactaccatttccaagtaa

SEQ ID NO: 229411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttactcgtcatgacgtctccataaccactttt

SEQ ID NO: 229412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttactgaagaggatcatataatcgcgacgcac

SEQ ID NO: 229413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttactgaattaatacttattcgccggtacgtt

SEQ ID NO: 229414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttactgcgatctaggggaaacaacaacgcttg

SEQ ID NO: 229415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttactggtactggcgatgcttgccttaagcga

SEQ ID NO: 229416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttactgtcatgttgttacatgcgtcgtacgtg

SEQ ID NO: 229417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttactgtgaccctactgagaaaacggtcaagc

SEQ ID NO: 229418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacttaccataatcacacgagctgcggtgta

SEQ ID NO: 229419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacttaccccgaactgctctcaggacattct

SEQ ID NO: 229420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacttaggcttcgtctctctatctaggtgtc

SEQ ID NO: 229421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacttatgcagacttactcacggggagtgtt

SEQ ID NO: 229422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacttgctacttggactctgtctccgtcgcg

SEQ ID NO: 229423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacttggatctgtttcagtatggatctttgc

SEQ ID NO: 229424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttacttgttgcgtatgtgtctcggggtgtcca

SEQ ID NO: 229425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagaaagggggaaaccgtctattaatgtgcc

SEQ ID NO: 229426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagaaatatcgggaatgaaaagggtcaacgg

SEQ ID NO: 229427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagaactctcgaatctcgcagtgccgcgagg

SEQ ID NO: 229428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagaagtatttttatgtcattcttactgttt

SEQ ID NO: 229429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagacacagacgctgattctacccttgtccg

SEQ ID NO: 229430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagacacagtttgtagggtgataggcgaggt

SEQ ID NO: 229431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagacaggcaggtcatgactatgaatttgtt

SEQ ID NO: 229432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagacgttgtctccttaaagcctctatggtg

SEQ ID NO: 229433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagactagtttcgatttggacttcttgtccc

SEQ ID NO: 229434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagagcgccgtcacggtcaggtatatgccct

SEQ ID NO: 229435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagaggggaaggtttcgctgtgaaaactttg

SEQ ID NO: 229436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagatacgaattcctaggtggagcagcatct

SEQ ID NO: 229437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagatctcggctcaggttcgtaaagcaacat

SEQ ID NO: 229438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagatgttgaatccctctaggttgtgtagct

SEQ ID NO: 229439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagattttctccgtcagggggactaaaacgc

SEQ ID NO: 229440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagatttttatgatggtttaaacgggtcaaa

SEQ ID NO: 229441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagcaatgacaagggcgtatccacgcatcgt

SEQ ID NO: 229442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagcagccgtcttagctcagtgcgagatact

SEQ ID NO: 229443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagcagtgtcatgtgccagcgagcttatatc

SEQ ID NO: 229444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagcataaaccgtaagaaggtgtggagtagt

SEQ ID NO: 229445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagcataccagcaatcgaagtcgagtgtggc

SEQ ID NO: 229446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagccacctgtaagatcaatgggtagggccc

SEQ ID NO: 229447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagccaggatccagtttgtactcaagacggt

SEQ ID NO: 229448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagcccaatattactcttccaggaagtgttc

SEQ ID NO: 229449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagccccgtacaccctgaatgaacgcgcggc

SEQ ID NO: 229450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagcctcttcacccgtgtagactcagaatgt

SEQ ID NO: 229451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagctatccacctccctatttccccagtgtt

SEQ ID NO: 229452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagctcttccgtcggtttagtggtaagtggt

SEQ ID NO: 229453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagcttggctccgaatcggaactaggcctct

SEQ ID NO: 229454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagctttgacgcggataaacggttcttttat

SEQ ID NO: 229455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaggacaataggagtggggtttttcttttgt

SEQ ID NO: 229456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaggagactgggtgttcgccggacaaagttc

SEQ ID NO: 229457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaggcagcagttgagcgggttatatcctgtg

SEQ ID NO: 229458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaggccaattgtctgcctggcactcaacacc

SEQ ID NO: 229459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaggccgttgcattattttcgaaatagtata

SEQ ID NO: 229460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagggaatgggaaccgtaccagaacatgtcg

SEQ ID NO: 229461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaggggaggtcatgagaaagtcccatgcggc

SEQ ID NO: 229462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaggggataattagggagtatttgactccac

SEQ ID NO: 229463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaggggattgatggaattgatgacagggatt

SEQ ID NO: 229464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaggggtacttgtgatattagtagcccatct

SEQ ID NO: 229465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagggtttagctaggcaggaatcggatttgt

SEQ ID NO: 229466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaggtaaatcaaattatgcttcatggttttc

SEQ ID NO: 229467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaggtaggcttgcggtcgtagaagatttgtc

SEQ ID NO: 229468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaggtgacgggcataggtatacaacgcagca

SEQ ID NO: 229469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaggtgatcggtaagatcatgtatgtcgaca

SEQ ID NO: 229470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaggtgtggggctagggcatctcttcgactt

SEQ ID NO: 229471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaggttcgacagctgatctgtcgaaacattc

SEQ ID NO: 229472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaggttgtattcaaccattcgatgcctatta

SEQ ID NO: 229473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttaggttttaattccgtacggtttgccatttt

SEQ ID NO: 229474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagtaatctcgtgtattaagggagtgattag

SEQ ID NO: 229475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagtagacaggaaagaagtccttgccatgac

SEQ ID NO: 229476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagtagaggactctatggtcgggtgtctgcg

SEQ ID NO: 229477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagtagctgtctaatcgacatcgtcccataa

SEQ ID NO: 229478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagtagtggacaggaggcacgaggtttgggg

SEQ ID NO: 229479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagtcggggaaaccgctgccgtgccatagtc

SEQ ID NO: 229480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagtcttatgggttgcgtgaaccggttcgtt

SEQ ID NO: 229481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagtgcacagctcggatattcttagtcctgc

SEQ ID NO: 229482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagtgttgattcccctggtcggacgatgcaa

SEQ ID NO: 229483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagtgttgcgaaaattcgttaacttccagtt

SEQ ID NO: 229484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagttaattcagaggggaggtccataacagt

SEQ ID NO: 229485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagttcggcgacgtggaagttgccgagtttc

SEQ ID NO: 229486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagttcttacctcttactgttaaaagtgtgg

SEQ ID NO: 229487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagttgcgatactgctaccatttcgatcctt

SEQ ID NO: 229488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttagtttatggtagctcaaaagccttttagct

SEQ ID NO: 229489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttataacatgtgccgtctcccgacatgtgtgg

SEQ ID NO: 229490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttataagcaagctgttgataggtgagtaggcg

SEQ ID NO: 229491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttataagcctaaggtgcttctgcgcagttagg

SEQ ID NO: 229492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttataaggatccttccccttcgtatccatctt

SEQ ID NO: 229493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttataatattggttgtgcgcttttctgctttt

SEQ ID NO: 229494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatacaatgcatccgggtatatcttacgagt

SEQ ID NO: 229495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatacatgctggttccagagattggagttcg

SEQ ID NO: 229496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatacgctctctgtgttctcatggatcactc

SEQ ID NO: 229497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatagaccgacaccatgaactgtagtttgtt

SEQ ID NO: 229498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatagcaattcaagcgggagttatcgtattt

SEQ ID NO: 229499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttataggatatttctgtcgtgattgttaatgt

SEQ ID NO: 229500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttataggtcggggaagggcagtaatacacgcg

SEQ ID NO: 229501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatatccctgctgaaatcgctaggcatgcta

SEQ ID NO: 229502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatatcttgggcgtatatgtcccagtattcc

SEQ ID NO: 229503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatattcacatatatcttcgcaggtggcgtt

SEQ ID NO: 229504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatattgcgttggtaggtttgtcgcgttcgt

SEQ ID NO: 229505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatcaatgtccatgatcgattcgaagccgtt

SEQ ID NO: 229506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatcaattgagtgacgctccaccgtgcatca

SEQ ID NO: 229507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatcacgcgtgtcctgtaaggagtcttcggg

SEQ ID NO: 229508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatcactgtccggcattaacaggctttatcc

SEQ ID NO: 229509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatcagatatagggttgagtggaggctatgt

SEQ ID NO: 229510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatcagtacattcggtctgtgcgtaactccc

SEQ ID NO: 229511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatcagtcctagattcagatccctgctggac

SEQ ID NO: 229512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatcatgggtagcctagagttcctaccgccg

SEQ ID NO: 229513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatcattgatcaacccgattcctaatagaat

SEQ ID NO: 229514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatccaagtgtagacgtcttcttcacgtgag

SEQ ID NO: 229515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatccacatgttgaaccattctctgtgggct

SEQ ID NO: 229516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatccagatctcccaaaaccgctaaaggttt

SEQ ID NO: 229517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatccagggtcctgatggtatgcaatgttat

SEQ ID NO: 229518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatcccagcttcccgcatccgtatggaaaac

SEQ ID NO: 229519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatcccatagtcgtaatcctttcatgtatgt

SEQ ID NO: 229520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatccgctgggggaatggatttggatgtgtt

SEQ ID NO: 229521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatccttggtaccgagtccgacatattggcc

SEQ ID NO: 229522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatcgatggagaatattcgtatctctgacat

SEQ ID NO: 229523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatcgcacgtcgctactattgatccagcaga

SEQ ID NO: 229524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatcgcgataccattgtccatccatcggttt

SEQ ID NO: 229525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatcggcacatggtatccggtaaccctggtt

SEQ ID NO: 229526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatcgggaactggcaggacatggttaaatgg

SEQ ID NO: 229527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatcggtggtgcggggcatgacgggtagatc

SEQ ID NO: 229528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatcgtagggaatcatcagccgtgtctgggt

SEQ ID NO: 229529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatctaacaaattattaaacgcagaattgat

SEQ ID NO: 229530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatctaagactaccgatcttttcaatagggc

SEQ ID NO: 229531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatctagactggatgcttggtttatcgggtg

SEQ ID NO: 229532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatctcgactcgtgtggatacccggggctga

SEQ ID NO: 229533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatctcggacagattgatgatgatgctgatt

SEQ ID NO: 229534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatctggcagcttttgtcggggcttaccagg

SEQ ID NO: 229535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatcttggcgctctaaggatccgtgtggcgg

SEQ ID NO: 229536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatcttttctatatgccgccctgtgttccgg

SEQ ID NO: 229537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatgaactcgtggttagtgtagcctcccttc

SEQ ID NO: 229538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatgaattccactggatgaactcttttatga

SEQ ID NO: 229539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatgacacaaatgagacacgagtacgacctc

SEQ ID NO: 229540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatgagatctattatggattccaatggactt

SEQ ID NO: 229541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatgaggggttttgttcctaccttgggacat

SEQ ID NO: 229542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatgagttaatagtggatatgcttatcgagg

SEQ ID NO: 229543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatgataatggtggatttctgtgtatcactg

SEQ ID NO: 229544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatgcaagagcgcctgccaaccgctagtttt

SEQ ID NO: 229545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatgcaatgcgtctataacgctcgttcccga

SEQ ID NO: 229546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatgcatttaagcaaaatgtttttaatcctt

SEQ ID NO: 229547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatgcctaactgatatgatatgctttggata

SEQ ID NO: 229548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatgcgcatgagctgaatgtcactataagtt

SEQ ID NO: 229549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatgcgccatgtatgtttttatagttgacat

SEQ ID NO: 229550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatgcgggcagccctaataagctttggatat

SEQ ID NO: 229551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatgcgtcattcgggggacggtggaagggca

SEQ ID NO: 229552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatgcgttaagggttacctgtaaatatttgc

SEQ ID NO: 229553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatggaaaggcattgtttcgcgcggagaccc

SEQ ID NO: 229554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatggcagtacatttgcttcaatgatacatc

SEQ ID NO: 229555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatggcggtatattgcgtcctccctaggtgg

SEQ ID NO: 229556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatggcgtgcagtggagcggtaaattacggt

SEQ ID NO: 229557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatggcttcctcgttaatcaggggcacgact

SEQ ID NO: 229558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatgggagcggctgatgcgcttttcccaagc

SEQ ID NO: 229559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatggttgcctgcgaagagcgcgataggccc

SEQ ID NO: 229560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatgtaaccctcggatatctctcagaattca

SEQ ID NO: 229561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatgtgcaatgctttcactcccccggcgccg

SEQ ID NO: 229562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatgttagttgttactgtgacgttggatggc

SEQ ID NO: 229563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatgttctcatcgttgtgttccaagagcatg

SEQ ID NO: 229564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatgttgcgtatggagtgtataaacgactaa

SEQ ID NO: 229565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatgtttccggagttacttttggtattaaga

SEQ ID NO: 229566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttattagccagatcttttttaattcggctgtt

SEQ ID NO: 229567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttattataacttcgcccacgtaccgttttggc

SEQ ID NO: 229568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttattatttcacttagtaggataccgcggtcg

SEQ ID NO: 229569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttattcacttaaactactttttcccagtaacc

SEQ ID NO: 229570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttattcagatggaaagcgaattcagcgtagtt

SEQ ID NO: 229571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttattcccgattacatttgttctgggtgtgct

SEQ ID NO: 229572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttattccgaagacccagtacggcgtcgtgttg

SEQ ID NO: 229573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttattcctaacgcattggcgagctaagccgct

SEQ ID NO: 229574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttattcgtagccatcaccacgcttctgcatcg

SEQ ID NO: 229575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttattctaacgcttcggctttctgtgtccagc

SEQ ID NO: 229576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttattcttggttagaaaatgtcatccgtacgc

SEQ ID NO: 229577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttattgcactcaccgtgacgaatcaggcgggt

SEQ ID NO: 229578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttattgccaagggtgtgtcattcgcactctct

SEQ ID NO: 229579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttattgccgtgccgtcaagtctgcgttatcta

SEQ ID NO: 229580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttattgcgattgtacttcatccatgctcgccg

SEQ ID NO: 229581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttattgggcgaaggaacgaacttctcggttac

SEQ ID NO: 229582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttattgggtgcgcgctttctcgttttcgtgtt

SEQ ID NO: 229583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttattggttactggatggtactatcatagtaa

SEQ ID NO: 229584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttattgttcggtgcgcgacccgtcccctcatc

SEQ ID NO: 229585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatttactttggcggtgcgcgggtttataca

SEQ ID NO: 229586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatttatgccaggtttgagctcgtataggga

SEQ ID NO: 229587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatttccaacttgccaaacttacacatgcca

SEQ ID NO: 229588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttatttgatccaggttagggtgtaacgtgcgc

SEQ ID NO: 229589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaaaatggtagattgactcacgccttacgc

SEQ ID NO: 229590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaaacgaaaggtagcgcggtcccagaccct

SEQ ID NO: 229591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaaatagcagccagtttgctaaatttatcg

SEQ ID NO: 229592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaaatctgtatcgtatagtaattttgatcc

SEQ ID NO: 229593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaacaacctcaacatgtatcagaactctgt

SEQ ID NO: 229594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaacacaaaagtgcttcattgcgcatcatc

SEQ ID NO: 229595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaacaccctgcacttcgtaaggcttctagc

SEQ ID NO: 229596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaacacgcgattctctgcttatgtacgctg

SEQ ID NO: 229597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaaccatcttgtgttcctccccctgatttt

SEQ ID NO: 229598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaacgcctgagtgtgcttttgcatctctct

SEQ ID NO: 229599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaacgtagtcgtctgatactttgattaata

SEQ ID NO: 229600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaacgtgatgtttatgggaactgagtactc

SEQ ID NO: 229601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaagacacgatgcttggtttctcgtcccct

SEQ ID NO: 229602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaagacgatgaaagcgaggccaccacgatg

SEQ ID NO: 229603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaagactttgatactttactggagcataga

SEQ ID NO: 229604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaagatccgaagtatagatcagtccgacga

SEQ ID NO: 229605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaagatgccgtattgaccagttttcagcat

SEQ ID NO: 229606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaaggttgcacacaagccgcagttagatta

SEQ ID NO: 229607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaagtagggtaccatggtggtgtgcccagt

SEQ ID NO: 229608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaagtggtggcaattttagaacggttagcg

SEQ ID NO: 229609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaagtttatacagatgtttttcgtggcatt

SEQ ID NO: 229610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaatatataaattatcgtggtgtttttctc

SEQ ID NO: 229611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaatccagtttatccttattgtatcaaacc

SEQ ID NO: 229612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaatggaaatcggactccctcttttctggt

SEQ ID NO: 229613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaatggaagggataacgtccttatcgtgta

SEQ ID NO: 229614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaattttgccatgaaggtaaccactgtttt

SEQ ID NO: 229615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcacaatttcctgggctaggcggtgtatctc

SEQ ID NO: 229616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcacacctctatcatcgggctggtcaccgtt

SEQ ID NO: 229617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcacacgttagccagccctgccgtcagttgc

SEQ ID NO: 229618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcacatagacgagtattcaaagacccggctg

SEQ ID NO: 229619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcacatggggaagtcgtaaacggccgttcgc

SEQ ID NO: 229620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcacatgtgaacttcgtgtttgcttgtgttc

SEQ ID NO: 229621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcacattcttacgtttgcgctacgctgcgtg

SEQ ID NO: 229622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaccagtcctgaacggccgcgaaggcgttg

SEQ ID NO: 229623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcacccgtgtgggatgagtcgggttgctctg

SEQ ID NO: 229624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaccctaatcaacgagggcacaacctgtag

SEQ ID NO: 229625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaccttgctttatttccagcatgagcggtt

SEQ ID NO: 229626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcacgcctctgacgaggtatcacaagttttt

SEQ ID NO: 229627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcacgcgtttatgacctcttgcaattgttaa

SEQ ID NO: 229628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcacgcttagcccctcgttggtcgacgtttt

SEQ ID NO: 229629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcacggagatctttaaagctagtcactctca

SEQ ID NO: 229630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcacggtggtcctctttgaaaaggcatgctg

SEQ ID NO: 229631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcacgttttcttggggttgggccgacactcc

SEQ ID NO: 229632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcactatgttgctgaacaatggtcggacgtt

SEQ ID NO: 229633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcactcatgcaggacgcgtacagcgatgggc

SEQ ID NO: 229634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcacttccacctagtggcttattgcggcgca

SEQ ID NO: 229635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcacttgacgtttcctgacggtgaagcaagc

SEQ ID NO: 229636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcacttgccttcgtaacatcactcgatggga

SEQ ID NO: 229637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcactttcccgcagcgtcctcatcgggttag

SEQ ID NO: 229638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcacttttagacccctacctgtacccagcat

SEQ ID NO: 229639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcagaccaccgtaccaaatcaatgcttcttg

SEQ ID NO: 229640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcagactgaaatttttcattttgtacggttt

SEQ ID NO: 229641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcagactgcttagctcttaaaatgtacgtcc

SEQ ID NO: 229642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcagactggttactcgattgtagcggggccg

SEQ ID NO: 229643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcagaggtcattgtggttacgtttatacttt

SEQ ID NO: 229644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcagagttttagctttatttattgtttagta

SEQ ID NO: 229645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcagattacgttgggtttgttcttcatatat

SEQ ID NO: 229646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcagattcatgcagtacagctgtgagcttgg

SEQ ID NO: 229647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcagcctgatttgaagacatacggtacacct

SEQ ID NO: 229648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcagcgaccttatcatctgttttgcggtcgg

SEQ ID NO: 229649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcagcggttgctttctgttctagctttggcg

SEQ ID NO: 229650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcagctctctctccgctagtggctaggtgct

SEQ ID NO: 229651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcagctgtacgcattcaatttagagtgcggg

SEQ ID NO: 229652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaggagagcaatactgcctaggcctagcaa

SEQ ID NO: 229653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaggatagcggtaagcccagtctcgtctta

SEQ ID NO: 229654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaggatggggtctcatcatacaaatgccca

SEQ ID NO: 229655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaggctcagtggggatgtataactcccgtc

SEQ ID NO: 229656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaggctcgtccacgttcttaatcgagactt

SEQ ID NO: 229657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaggtactattgcgctcccgttaacctttg

SEQ ID NO: 229658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaggtagctgattataactattttctgact

SEQ ID NO: 229659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcaggttatggttacatatgcacatagtggc

SEQ ID NO: 229660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcagtacaaaagaatagccataaagacattg

SEQ ID NO: 229661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcagtaggtgcgtttgacggtgttctctcac

SEQ ID NO: 229662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcagtatcctacatgcctggaatttcggtat

SEQ ID NO: 229663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcagtcccctgtgtaaccacatcagcgtacg

SEQ ID NO: 229664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcagtgattcattctacttgtcgcgacttcg

SEQ ID NO: 229665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcagttaggggaaatagggccttactgcgta

SEQ ID NO: 229666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcagttccgtgtttaatggtcaaatttgggg

SEQ ID NO: 229667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcatactggacgtcatcgagttatacctatg

SEQ ID NO: 229668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcataggcaccagggacggttcgttcgcggc

SEQ ID NO: 229669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcatagtagtaggatcattacaaccacaggt

SEQ ID NO: 229670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcatatgcaatacactctgatcacgttctgg

SEQ ID NO: 229671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcatcataaacgtaaactatgtatgctatgc

SEQ ID NO: 229672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcatccacgagtgttaggctggcgataggcg

SEQ ID NO: 229673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcatcctccgtagcgttatcgcgctggtttt

SEQ ID NO: 229674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcatcttcacctcctatactgcggcgaagag

SEQ ID NO: 229675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcatgtcccttgtatctacatatggtatcgg

SEQ ID NO: 229676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcatgtgcgttactcgcagtgtagatccgta

SEQ ID NO: 229677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcattagggaccaatacttgcatctatgctt

SEQ ID NO: 229678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcattagtatttagtccgcgcgaattttgtg

SEQ ID NO: 229679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcattagttccttaggtttcttcggttttga

SEQ ID NO: 229680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcattgacagtaggtgctctactcggcccgg

SEQ ID NO: 229681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcattgctactgttctattggttagtgtacg

SEQ ID NO: 229682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcattgcttggtaaggtctgcccaacacttt

SEQ ID NO: 229683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcatttacgcagtaggtttctgataaacgct

SEQ ID NO: 229684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcatttcgggaaaaagggatcgacccgaggg

SEQ ID NO: 229685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcatttctcttcttagcataatgagacagag

SEQ ID NO: 229686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcattttcggcagtaggagattatctcttgt

SEQ ID NO: 229687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccaacggccaacatgcacagaatcgctgac

SEQ ID NO: 229688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccaagtccacgtgcctgcagttttctcgcg

SEQ ID NO: 229689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccaccatggtccacccgctctagcacgctc

SEQ ID NO: 229690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccagaaatcggttacggcactttcagttgt

SEQ ID NO: 229691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccaggcgggcttcgaccttttcagttcttg

SEQ ID NO: 229692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccaggtctcaaagacgaacgtgcaagaggg

SEQ ID NO: 229693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccagtgggccatgcggataaaccattgcat

SEQ ID NO: 229694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccatacagttagatgaccaacgtatgaatg

SEQ ID NO: 229695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccatacgttatcgtgtctccactaatcgtc

SEQ ID NO: 229696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccataggagttgtaggcagtctcgggtgtc

SEQ ID NO: 229697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccatccaacatcgtgccattcagttgtggt

SEQ ID NO: 229698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccatcccccagtcgcagggattctcgccca

SEQ ID NO: 229699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccatgtttcacgcacagttcccggtcactg

SEQ ID NO: 229700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcccacgtctggtatcacactacccgagatt

SEQ ID NO: 229701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcccagttggcagtcaggctatggttggcga

SEQ ID NO: 229702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcccatgtctgctaataatgacacatctcac

SEQ ID NO: 229703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccccagaaaatcaggaggccaatactcaat

SEQ ID NO: 229704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccccatctaccgtggtttgaattatctgtt

SEQ ID NO: 229705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccccgggacatacttttatactccctcgtg

SEQ ID NO: 229706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcccctcaatgtcactgggtgtgcttgccgg

SEQ ID NO: 229707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcccgattgtcctgttttctaaggttataac

SEQ ID NO: 229708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcccggcctgtaattctccgctccggtaaga

SEQ ID NO: 229709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcccgtcagcgtacacacgttctggttcttc

SEQ ID NO: 229710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcccgtttctgcttgaatgctgctttgggtg

SEQ ID NO: 229711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccgaacagtgagtaagtcgcctgggtgacg

SEQ ID NO: 229712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccgagattggcaacacatatctggtaggtg

SEQ ID NO: 229713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccgaggaggtaccaaacttcaattatccgg

SEQ ID NO: 229714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccgataagatcggttgcgtcattttctatt

SEQ ID NO: 229715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccgatagaggcgataatgcgcgtttcgcca

SEQ ID NO: 229716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccgccactgctcgatatgggatcctggtct

SEQ ID NO: 229717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccgctccgctaccgtaagtctcgcatagcg

SEQ ID NO: 229718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccgcttaggttaattaccacacggtattgg

SEQ ID NO: 229719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccgcttctggcggttaacatgcgttcactg

SEQ ID NO: 229720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccgcttggtcttcattatgagctttatcct

SEQ ID NO: 229721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccggctctgccttcttcccattgtcggatc

SEQ ID NO: 229722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccggtattcccagatgggctgggtatttct

SEQ ID NO: 229723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccgtcactatttgtactttgtctgcttctc

SEQ ID NO: 229724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccgtccgaaccgctattcattgctgcgtac

SEQ ID NO: 229725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccgtccgtctgcttggactagcccatttcc

SEQ ID NO: 229726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccgtctgtaaaatgttaatactgcgctcca

SEQ ID NO: 229727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccgtgcttgtccttgtcgatatcactgtgc

SEQ ID NO: 229728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccgttaggtattcgctactatcgtggggtc

SEQ ID NO: 229729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccgttctgtgtctggtcatagtgtacggcc

SEQ ID NO: 229730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccgtttactgttcattagttgtggctctcg

SEQ ID NO: 229731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccgtttgctttccgcctctccatagtgtct

SEQ ID NO: 229732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcctaaattctctactttgcctgagactttc

SEQ ID NO: 229733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcctaagcctccttgcgtctttgctttcatt

SEQ ID NO: 229734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcctacatgtctaacggaccactctctgggc

SEQ ID NO: 229735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcctaggctatgttcacatgcgtttaccttc

SEQ ID NO: 229736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcctatcccgcagtgcagattcgatttaagg

SEQ ID NO: 229737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcctatgcatccaacgtaccagatccatcct

SEQ ID NO: 229738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcctatgcatctagagctgaagacgccacac

SEQ ID NO: 229739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcctcatgatgattatgttatcccatggtgg

SEQ ID NO: 229740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcctccaaactaagctcggccttataccgat

SEQ ID NO: 229741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcctgagattaagtcaacaggattctggttc

SEQ ID NO: 229742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcctgatacgtatgggattctgttttcgcat

SEQ ID NO: 229743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcctgggtacaatgtgcttgtacatcgcggt

SEQ ID NO: 229744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcctgggtgctaatggttcccgcgataggcc

SEQ ID NO: 229745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccttacataggtcgaattctacgaggcgat

SEQ ID NO: 229746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccttatcattagtgtaaatctccgcgtttg

SEQ ID NO: 229747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccttccagggccgttacttatcttgatcaa

SEQ ID NO: 229748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttccttgtaggtttccagattaatttggcgct

SEQ ID NO: 229749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcctttacggaggtgacgagcccgtggctat

SEQ ID NO: 229750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgaagtgctaagatacgcgtcgtaattagg

SEQ ID NO: 229751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgaattgtactgcctggtgcctggtattga

SEQ ID NO: 229752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgaatttctcggttgctgcgcactgccttg

SEQ ID NO: 229753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgacacacatgtacgtcatgtccacttctt

SEQ ID NO: 229754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgaccatgtactcataacggcggttaaaga

SEQ ID NO: 229755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgaccttttgcttactttcgggaggaactt

SEQ ID NO: 229756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgactcttgatttgaactgctggaggctat

SEQ ID NO: 229757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgagattcgtcctgcttaacgttctgccgg

SEQ ID NO: 229758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgagattctggcaaggttttttgacgggtg

SEQ ID NO: 229759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgagctcttaacctctacaaattgttgcgt

SEQ ID NO: 229760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgaggacgggggcttgacatggcaagcttt

SEQ ID NO: 229761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgagtaagacttcattaacagctagtatgt

SEQ ID NO: 229762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgagtgagttttgttctcttgggatagacg

SEQ ID NO: 229763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgatacccgctcggtctaataggctaaacc

SEQ ID NO: 229764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgatactttttagctcccgtttcgggcggc

SEQ ID NO: 229765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgatgaccatatcgcggtagacggaatctg

SEQ ID NO: 229766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgattacaactagtggcatgccttagcttc

SEQ ID NO: 229767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgattcaggttggggcggaaggaataagtc

SEQ ID NO: 229768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgattcctcgcggtaggattgagcgcacgg

SEQ ID NO: 229769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgatttcccctggcgtaatctggctattaa

SEQ ID NO: 229770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgatttgtacggtcttgatacttccaggta

SEQ ID NO: 229771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgcaaagcacctccttctgcgtcttcgcgt

SEQ ID NO: 229772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgcactgtgggttgtttgtactgagcgggt

SEQ ID NO: 229773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgcatttcgcgtctcgtactgtgactgggt

SEQ ID NO: 229774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgccaaaagacgatcgtgaatgtcggtatt

SEQ ID NO: 229775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgccacagcttaagtgatctctgaacatgt

SEQ ID NO: 229776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgcccatgattttggaccatctgtgcgtta

SEQ ID NO: 229777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgccggagtccacaagcttcttatcgcacc

SEQ ID NO: 229778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgcgacttgctgcgttttcagcgctgttcg

SEQ ID NO: 229779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgcgcaaacgtgtgttaattcagtgtctat

SEQ ID NO: 229780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgcgcatagaggttgccttgggcagcatgg

SEQ ID NO: 229781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgcgcgttcatgatttaccttcatgttaac

SEQ ID NO: 229782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgcgctaccatcctacttagcatagaagtc

SEQ ID NO: 229783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgcggcagatggcaaggtgtttgttccgct

SEQ ID NO: 229784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgcgggtaaaatttagccaaaataaaatgc

SEQ ID NO: 229785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgctcttggttgttcactttgtcgcaccac

SEQ ID NO: 229786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcggaatgaatcccaggctgggtgcatcacc

SEQ ID NO: 229787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcggaggcaacgtgatttcccgttatttcct

SEQ ID NO: 229788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcggcacggacacatcattgacttttaccta

SEQ ID NO: 229789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcggcagaggtcggtcagctaaccaaatggc

SEQ ID NO: 229790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcggcattccaaggatatggttagaatccca

SEQ ID NO: 229791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcggcgccctggttgtgttcaccgtagtctt

SEQ ID NO: 229792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcggctcactttcatgggcgcacgtgcaacc

SEQ ID NO: 229793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcggcttctttctgccaatatcactgctatt

SEQ ID NO: 229794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgggaacatcgatattggtgagtaagtacg

SEQ ID NO: 229795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgggatttatctaaaggctcactccgttag

SEQ ID NO: 229796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgggctaagggcccaccttgctgcttattt

SEQ ID NO: 229797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcggggcagtgcggtaggtcgtcagttatcg

SEQ ID NO: 229798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgggtatacgtgtcattaacataagtgccg

SEQ ID NO: 229799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgggtctgaaacggttcaggggtttgtcgt

SEQ ID NO: 229800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcggtaatgctgggcgagcgttcttacatgg

SEQ ID NO: 229801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcggtgaatagtgctgggatatgcaagcgcg

SEQ ID NO: 229802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcggtgcatcaaatagttcccatgctccgta

SEQ ID NO: 229803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcggtggtttttgtatgccttacgggatggt

SEQ ID NO: 229804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcggttgtccacggggttcgagcggacggtg

SEQ ID NO: 229805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcggtttcatccgtaaaatcgcttgaacgtg

SEQ ID NO: 229806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgtaggccaagaacgccgacgcgcgttaat

SEQ ID NO: 229807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgtaggggttggtctcactgagtgattctg

SEQ ID NO: 229808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgtgaaatggaatggactcccaagactccc

SEQ ID NO: 229809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgtgatgtcccacgtttgatcatgccatac

SEQ ID NO: 229810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgtgcaactataatctcgagctcccagggc

SEQ ID NO: 229811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgtgcccgatagataggaaagaatctggct

SEQ ID NO: 229812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgtgcgttcaacttcggacaaaggagtagg

SEQ ID NO: 229813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgttactagagccatcctttgcttagcaga

SEQ ID NO: 229814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgttgggacagacataaaattgtgacagta

SEQ ID NO: 229815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgttgtcttagccgtttcaatgtaatttct

SEQ ID NO: 229816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgtttatgccgtttgcataggggcaggaag

SEQ ID NO: 229817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgtttcctgcagcgagtgacgttagcatat

SEQ ID NO: 229818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcgtttccttctgtgatgtatgtgaagaata

SEQ ID NO: 229819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctaaccaccattttactctgatgtctgttg

SEQ ID NO: 229820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctacattcttccgtcgggtgcttgctcatg

SEQ ID NO: 229821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctacggttctttatgggcgacggtttagcc

SEQ ID NO: 229822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctacgtgtgtaactggcccgtctaagctgc

SEQ ID NO: 229823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctactgttcttcgcttcgtgtatatttctc

SEQ ID NO: 229824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctacttatattcttatccgggacggcacat

SEQ ID NO: 229825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctagaaaagagtaagagctggcccggtagg

SEQ ID NO: 229826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctaggaacgttagttgaaggtatgagatta

SEQ ID NO: 229827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctaggcagatggtcgtaatcacgcgctgac

SEQ ID NO: 229828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctaggtggatcagctgacccgcacgacagg

SEQ ID NO: 229829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctatcgcgctaggatctgctctctcctgtc

SEQ ID NO: 229830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctatctcacacgggtcggatggctacgttg

SEQ ID NO: 229831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctattttaatttgttaggataagctaggtg

SEQ ID NO: 229832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctcaaataatgttagagaggaggctctata

SEQ ID NO: 229833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctcaagacttcgttggactcgcgccgaact

SEQ ID NO: 229834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctcaagcgtatacctcctggcggtgacttt

SEQ ID NO: 229835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctcaattccttggttacgagacggtaggga

SEQ ID NO: 229836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctcacacaaaggggtagcaaccccggatca

SEQ ID NO: 229837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctcaccttgctttcgcggttcttcaatgta

SEQ ID NO: 229838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctcactctctattgccaatattgttctctt

SEQ ID NO: 229839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctcagtcgttcaaatattctgtttgtaaga

SEQ ID NO: 229840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctcattgtcttcttagccgattggtttcct

SEQ ID NO: 229841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctccaagtgtcgttaggatgcgatatacga

SEQ ID NO: 229842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctccatcatccagagtggctgattagcttt

SEQ ID NO: 229843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctcccatgtgtgcaagtactgctgcatgcc

SEQ ID NO: 229844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctccccatgaccagcatgcaagatgcgtaa

SEQ ID NO: 229845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctccgactgtcgttaggcccgaatttttta

SEQ ID NO: 229846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctcctgctgcattccatatacccaggaccg

SEQ ID NO: 229847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctcgatactgcgacaattctcccatgtgcg

SEQ ID NO: 229848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctcgctagggtaactcgaaatgcagggcat

SEQ ID NO: 229849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctcgctcgttaatgcatgtcgccccgtgga

SEQ ID NO: 229850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctcgtcttgagtgcatcaggatgtcgtcat

SEQ ID NO: 229851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctcgtgagccagcactatttgcgtaagtat

SEQ ID NO: 229852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctctagcaatacggttgctgtcactgaatt

SEQ ID NO: 229853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctctaggcttccggtccgaggttgcgttcg

SEQ ID NO: 229854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctctagttggtgtttcctttcactagacga

SEQ ID NO: 229855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctctcccgtaaacttgtgtttgtccggctt

SEQ ID NO: 229856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctctgaaagctcacctcctatacaccaccg

SEQ ID NO: 229857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctctgacgtcatgtacaggggttaagctct

SEQ ID NO: 229858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctctgggttaggtatgcaaactcttcattc

SEQ ID NO: 229859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctctggtaatgcgtcaggtcggcaagggtg

SEQ ID NO: 229860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctgaagactaacatttggtttcatgggggc

SEQ ID NO: 229861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctgaatttctaaagggctggcccagaaacg

SEQ ID NO: 229862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctgacgggagcacgcaaggtttttaggtgc

SEQ ID NO: 229863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctgcacttacctgtgaatgaccgctacgcc

SEQ ID NO: 229864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctgcagagccgtcacgcttatccactgggg

SEQ ID NO: 229865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctgcggatcgctgctgtccagatagagtca

SEQ ID NO: 229866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctgctactgggattaataccctttagcacg

SEQ ID NO: 229867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctggagggattcactttgattgttcggtga

SEQ ID NO: 229868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctggattggacctgttaaaattggtaagcg

SEQ ID NO: 229869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctggcacttgatgtccgtgcgtcacgttct

SEQ ID NO: 229870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctggctactttgacggagtactctcgtact

SEQ ID NO: 229871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctggctgataagtaccaacatcggcacggg

SEQ ID NO: 229872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctgggacccctttacgtgctgtgctttgtc

SEQ ID NO: 229873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctgggtcagaaggatcccacgctatagtcc

SEQ ID NO: 229874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctgggttggaatgactacatatcaacaata

SEQ ID NO: 229875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctggtactttacgatagttttgtagttcga

SEQ ID NO: 229876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctggtattttggatgggcatgattctcctt

SEQ ID NO: 229877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctggtctcttgagccgggatacgcaccttc

SEQ ID NO: 229878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctggtttctatgtttcccgagatgcgtttg

SEQ ID NO: 229879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctgtactgtctagaaggcatttggcacctg

SEQ ID NO: 229880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctgtagttttctcttttgcatcttaagcct

SEQ ID NO: 229881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctgttcccctttgtgctgtagtcctgccga

SEQ ID NO: 229882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttaacatgtctaagtgcagttcccttttt

SEQ ID NO: 229883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttaagttggtattactatggcctggtacg

SEQ ID NO: 229884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttagaccgatcatgtttaattgtaaactc

SEQ ID NO: 229885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttagcatttgagcataggcggtgtaaggt

SEQ ID NO: 229886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttagctctcgtctataggtgggactggga

SEQ ID NO: 229887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttaggtatgctatttttcagtgcagcatg

SEQ ID NO: 229888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttataacgccggactccggtgtgtcctcg

SEQ ID NO: 229889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttataccggtacttgtgtgaccaccccta

SEQ ID NO: 229890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttatgttgttatgtcccgggataggcacc

SEQ ID NO: 229891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttcaggcgggcaacaggtttcatggcacc

SEQ ID NO: 229892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttcagttgccggtggtctcgttaccggaa

SEQ ID NO: 229893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttcattgcgtcaggcgaccgttacgacgc

SEQ ID NO: 229894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttccgattaggtgctttctcggcgccgta

SEQ ID NO: 229895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttccgctagaaaccgcgctgtggccttat

SEQ ID NO: 229896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttccggcattaggctcttttatgtgagcc

SEQ ID NO: 229897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttcggtcgtttggcttttttactaaccat

SEQ ID NO: 229898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttcttcactaacgtatgccttctcaacgc

SEQ ID NO: 229899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttgccatttcaatatgaccgtgcgtggtt

SEQ ID NO: 229900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttgcttccatttagagcttttcgaacggt

SEQ ID NO: 229901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttggcttatgaattcgtacacccgagcgt

SEQ ID NO: 229902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttgggaccaggatctctagtcgtgtcccc

SEQ ID NO: 229903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttggtatgggccagtatgtaatataatat

SEQ ID NO: 229904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttggttttccgggtgtattatacggatcg

SEQ ID NO: 229905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttgtcaactcactgactgatttcacaacc

SEQ ID NO: 229906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttgtgcctgcttataaatcacagtggatc

SEQ ID NO: 229907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttgttgtaacagatttagttatgtacgga

SEQ ID NO: 229908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctttaattcttacgtggacttcaaacttag

SEQ ID NO: 229909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctttagactccttgcgaagtggttcttggg

SEQ ID NO: 229910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctttatatagcccccatccgctggtgtggc

SEQ ID NO: 229911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctttcaatcccttaggctttatcactccgg

SEQ ID NO: 229912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctttcgtttacgggtgaggatattaatctt

SEQ ID NO: 229913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctttcttgggttagggctcggggcactcga

SEQ ID NO: 229914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctttgcctgcacaggcacaaggttggggtt

SEQ ID NO: 229915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttttacgactggagtgtagacaggtcacc

SEQ ID NO: 229916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttttctaagtgcgaccaccccccccgcgt

SEQ ID NO: 229917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttttgtctccaatttgctctgtgatctta

SEQ ID NO: 229918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttctttttgtgcatagtcttgatgggatgcat

SEQ ID NO: 229919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttcttttttagttttccacctgctgaaatttt

SEQ ID NO: 229920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaaaagtgtaaggttatctgtgagttgcgc

SEQ ID NO: 229921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaaacacaccgtttaatataatcgtactac

SEQ ID NO: 229922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaaacactctccgaaacccgcgatgacttc

SEQ ID NO: 229923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaaagctccattgttctctattccggcgtc

SEQ ID NO: 229924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaaaggttgcagtactcaatatcgtgacac

SEQ ID NO: 229925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaaatattttttccacgggcaaaggaggag

SEQ ID NO: 229926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaacaaggcgtcagagtctaccttgctaat

SEQ ID NO: 229927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaacagcagcagggggtcccgagttagttg

SEQ ID NO: 229928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaacgattatttccgagaagcttttacgcg

SEQ ID NO: 229929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaactattcgagctgcactttcctcgcgct

SEQ ID NO: 229930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaactcgaagggatcgcgtaattccacacg

SEQ ID NO: 229931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaactggcaacgatggcagattgtgactcc

SEQ ID NO: 229932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaagcgcagcgtgcccaacggccgaagcac

SEQ ID NO: 229933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaagcggggagggcgacggggtaggaccgg

SEQ ID NO: 229934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaaggtataaatcatgtttacaactgtggc

SEQ ID NO: 229935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaaggttatcctagtcaaacgtcgtcacga

SEQ ID NO: 229936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaatcacccattgcatgtttggggggttgt

SEQ ID NO: 229937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaatgactataattgactttctttgccttg

SEQ ID NO: 229938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaatggtggggttcgatttccatgtggctg

SEQ ID NO: 229939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaattagaatgttgatatgctcacatccgc

SEQ ID NO: 229940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaattaggcaagcccgctgttctcgtaacc

SEQ ID NO: 229941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaattctacaaggttccctgaatattgggg

SEQ ID NO: 229942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaattgagattgtcctcgactttttagtac

SEQ ID NO: 229943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgacacgagcattgtcgcctcgatgtatttt

SEQ ID NO: 229944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgacagatgacaccatgcctccagatacacc

SEQ ID NO: 229945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgacaggtaaaggtttatacagacacgctct

SEQ ID NO: 229946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgacatatgtagtttgaacggccgtgggaaa

SEQ ID NO: 229947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgacatgaaatgttgacaaggttgccttggg

SEQ ID NO: 229948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgacattgccctttgtgtattccgtaggaac

SEQ ID NO: 229949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaccaataccatatgtcgactagtttcatc

SEQ ID NO: 229950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaccaggcccgtcatcacaaacatcgaagt

SEQ ID NO: 229951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaccccgtacctttttggaagttacttgct

SEQ ID NO: 229952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgacctatctagtttgcgtattcgtaatacc

SEQ ID NO: 229953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgacctctacaggccataggatagactaccc

SEQ ID NO: 229954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgacctgggccaagtttgcaccttgatatct

SEQ ID NO: 229955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgacgggcggtgcagtgtgcaattatcgagg

SEQ ID NO: 229956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgacgggcttttcactaacgatgaatgctta

SEQ ID NO: 229957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgacggtaatttccagtggctcgcgcttatc

SEQ ID NO: 229958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgacggtcgcgggcggatgttaatttaagtg

SEQ ID NO: 229959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgacgtaaccctggctggagggaacgctttg

SEQ ID NO: 229960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgacgtcttggttgtgtatcatgctgctgga

SEQ ID NO: 229961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgactacacccgaattttgtccgcttgggtg

SEQ ID NO: 229962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgactccgatacacggctatattcccgcctc

SEQ ID NO: 229963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgactgcagggttgctctgagcaggcggtac

SEQ ID NO: 229964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgactgcgggggtggaaggttgggatggcgc

SEQ ID NO: 229965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgactggctgctcttgagagtgaaacagctc

SEQ ID NO: 229966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgacttatgagattgcgcttacgtcttcggg

SEQ ID NO: 229967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgacttcaaatcttttattaggcagattcct

SEQ ID NO: 229968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgacttcgaaccaaggaagactcaacgtgag

SEQ ID NO: 229969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgacttgtctgttcagaagtcctggtgatgc

SEQ ID NO: 229970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgactttgtacagcgatacgtggatgcatgc

SEQ ID NO: 229971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgagaagccatccgcacctatacgctggatt

SEQ ID NO: 229972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgagaatggacgcgttgtcgtacgaattcgg

SEQ ID NO: 229973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgagagggcgtcgttaggagactgtggccta

SEQ ID NO: 229974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgagattgtgcctaaggtagagccctcatgc

SEQ ID NO: 229975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgagcagagcatcgcactggcagttccgtcc

SEQ ID NO: 229976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgagcagtggtttgattggtgatagttttcg

SEQ ID NO: 229977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgagccagagtcagcgcttatcagcgtcggc

SEQ ID NO: 229978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgagcgtgccatagactagttacgtcgcctg

SEQ ID NO: 229979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgagctgcattttacgccaagatatatccgc

SEQ ID NO: 229980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaggcctgtcgtgtcgggtctagtacacac

SEQ ID NO: 229981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgagggctggcagtgtgctttcccatttagc

SEQ ID NO: 229982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgagggggttaaaactggtacatttgttgat

SEQ ID NO: 229983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgaggtacaatgggaatcatctgcagggttc

SEQ ID NO: 229984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgataaaaggacgcaggcaaagctagggtcc

SEQ ID NO: 229985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgataaagccatgaagaccaatgttcccgtt

SEQ ID NO: 229986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgataacacgtccatgcgtttcaagcctctt

SEQ ID NO: 229987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgatacaggattagcttgttcatgtttacta

SEQ ID NO: 229988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgataggtatggttttgaagtgcgtatggac

SEQ ID NO: 229989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgatagttacggcggctggatgccatcaggc

SEQ ID NO: 229990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgatatacgagctgtaccaaataccatcgcc

SEQ ID NO: 229991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgatatgcgacatccctgtttttgattttct

SEQ ID NO: 229992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgatcaacttgtacattcatccgggatgccg

SEQ ID NO: 229993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgatccaaatgcgttagctacctacgattgt

SEQ ID NO: 229994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgatccagacaggacacctcctaattatgtt

SEQ ID NO: 229995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgatccatcaccggcctgcaacacgcgagat

SEQ ID NO: 229996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgatcctatgacatgtctgaccttatctagc

SEQ ID NO: 229997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgatgcggcctaactggatagctttggtggt

SEQ ID NO: 229998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgatggcctccttaataatgactattacctt

SEQ ID NO: 229999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgattattagatacattatcgtaagcttaaa

SEQ ID NO: 230000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgattattctcttatgagtagggtccgttga

SEQ ID NO: 230001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgattcaagtttttggcggcgcagctaccct

SEQ ID NO: 230002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgattctaaaagttacgagtctatcgaccgc

SEQ ID NO: 230003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgattgttacttttctcactgttacccacgt

SEQ ID NO: 230004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgatttgggggggagttaggcaaaattgggg

SEQ ID NO: 230005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgattttgtaagtctgatacaatgaaatctc

SEQ ID NO: 230006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcaactcacctacacttcttatataggtag

SEQ ID NO: 230007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcaaggcaatggcgactgatcctctgcctc

SEQ ID NO: 230008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcaagttggatggtgtattaagacccggtt

SEQ ID NO: 230009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcaataataaatcatccacatgatcgcgaa

SEQ ID NO: 230010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcaatccttttaagttctggccccttgagt

SEQ ID NO: 230011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcaatggccttggattcttggcgtgcatgt

SEQ ID NO: 230012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcaattgtcgactccatgctacgaaggggc

SEQ ID NO: 230013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcacagtaaggacatatgcgcgaacagcgc

SEQ ID NO: 230014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcacagttcaagctcgtggctcgtctttgt

SEQ ID NO: 230015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcaccacacttttgcggactgctaccagta

SEQ ID NO: 230016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcacccacgttcacgctagcttgtgtcgct

SEQ ID NO: 230017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcacctcgacggtctctaggacattgcgac

SEQ ID NO: 230018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcactctgtattctgcccttacgacattag

SEQ ID NO: 230019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcagataccagacaaacaggaagcaacgtg

SEQ ID NO: 230020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcagtagaggtaaggtttgatttctgattg

SEQ ID NO: 230021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcagtattgtaggcggatgcactttgcatt

SEQ ID NO: 230022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcagttggggtacggttcaccccctgtcac

SEQ ID NO: 230023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcagtttctgtacccgttatatgtatgctt

SEQ ID NO: 230024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcatacatacagatgtttggatagaatcat

SEQ ID NO: 230025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcatattaggatgcttggatttggtaattc

SEQ ID NO: 230026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcatcagtactcgggcaacgatctcggcga

SEQ ID NO: 230027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcatcctttaagcatgaaagccctagcatg

SEQ ID NO: 230028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcatcgccctggcaagtgatcgagcgggat

SEQ ID NO: 230029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcatgtggaagcttatcattccagccgctc

SEQ ID NO: 230030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcattcccgacttcttacacgcttccattg

SEQ ID NO: 230031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcattgattctgtcacttattgcccctcca

SEQ ID NO: 230032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgccaaactggtcgtgtgacgtgctctggtg

SEQ ID NO: 230033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgccactgctccggatgcttcactctggtgc

SEQ ID NO: 230034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgccaggtcgcaaccagtgaaaaccttacgg

SEQ ID NO: 230035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgccaggtgctttatggaactttatgggtgt

SEQ ID NO: 230036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgccagtgtaccctcgaccaggacctgccgg

SEQ ID NO: 230037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgccatgatatttgccgatatagcgcttacc

SEQ ID NO: 230038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgccatgcagttctccggaccggcggacgac

SEQ ID NO: 230039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgccatgtcgactcccttcacatactcgtca

SEQ ID NO: 230040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgccattcttcactggattctatatggtgtt

SEQ ID NO: 230041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgccatttccttctcacttgtgtgtcagatg

SEQ ID NO: 230042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcccatttcgttaattgttaaagtttaacc

SEQ ID NO: 230043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcccccagcagatccagctaggtgacttta

SEQ ID NO: 230044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcccgagaaggccggtttttttcctttggc

SEQ ID NO: 230045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcccggaatggtgcaagattgaaggttccg

SEQ ID NO: 230046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgccctgagaggcaatatcgccagttctttt

SEQ ID NO: 230047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgccctgctggttccatcatacgctggtttt

SEQ ID NO: 230048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgccgaagttggggttgtgatccttatatca

SEQ ID NO: 230049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgccggaaatactgctgcagatattcatagc

SEQ ID NO: 230050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgccgttcccagtccgccgtcggggtgcaga

SEQ ID NO: 230051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcctacctcatgtggcattttaagttctga

SEQ ID NO: 230052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcctactgtaattgagaattgttcctctag

SEQ ID NO: 230053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcctcttccgataataaagaacgtcctccg

SEQ ID NO: 230054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcctgggacctcacgatatgagcctattct

SEQ ID NO: 230055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcctgtcatttgtctgtcgggtggtcagca

SEQ ID NO: 230056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcgaacttgaaaattattcgctatcgctag

SEQ ID NO: 230057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcgaatccgtataacaaatgcaagttttac

SEQ ID NO: 230058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcgactgctcttccttaatctaaactaaaa

SEQ ID NO: 230059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcgataaatgtttaaggtttgttgctttcg

SEQ ID NO: 230060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcgcaccgtcggcagtagcctgcgttacac

SEQ ID NO: 230061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcgcattagtgacactagggacatccgcaa

SEQ ID NO: 230062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcgccgtacagggtgtaatttccaccttaa

SEQ ID NO: 230063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcgcgtgcataaacctagcggccaggttgc

SEQ ID NO: 230064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcgctctcaccctggctgtatcctgtaggc

SEQ ID NO: 230065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcggacttttccgttggaagataagcagcg

SEQ ID NO: 230066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcggcaacctcgtgattaagtgtgtggtaa

SEQ ID NO: 230067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcggcaatgatctcgcgaaccatatttctc

SEQ ID NO: 230068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcggcgaacagtacggggctcctccatggc

SEQ ID NO: 230069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcgggacagcagggtagctacattcctccc

SEQ ID NO: 230070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcgggatcgtcggcggcttggtttttctct

SEQ ID NO: 230071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcgggcgcgacattcataagtgtacctagc

SEQ ID NO: 230072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcggttgattgtccagtttggtactggtgg

SEQ ID NO: 230073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcgtaactttgcggtggttgtttggccgtt

SEQ ID NO: 230074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcgtgtcttctgttacttctagtaaagcat

SEQ ID NO: 230075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcgttagtcagggagtggcgcttgggactg

SEQ ID NO: 230076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcgttcatcgaggctttttacgtctaattg

SEQ ID NO: 230077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctaagtatagggcgctcagccctttgtgg

SEQ ID NO: 230078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctacaaatgtgagatactattctttacat

SEQ ID NO: 230079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctacatttgtacattaagcaatgtcacaa

SEQ ID NO: 230080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctacgaaattttgaacactctgttctcgc

SEQ ID NO: 230081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctacggtgtactaacgcaacgcgttcact

SEQ ID NO: 230082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctagatccggggacgtgtgtagctcgttg

SEQ ID NO: 230083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctataaaggctagttcgagcgactggagg

SEQ ID NO: 230084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctatggtagtcccatcgtttcagtgtcat

SEQ ID NO: 230085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctcagtttacgaaatcgtacggctttatg

SEQ ID NO: 230086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctcatggtccagcgcgtctgccctcccaa

SEQ ID NO: 230087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctcattctgtttgtactttccgccaaatt

SEQ ID NO: 230088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctcctgcctcggttagcctttccgtcatg

SEQ ID NO: 230089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctcgctgtttccatttgtctagaccgggg

SEQ ID NO: 230090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctcgtccccccagagtgtgatgggcattc

SEQ ID NO: 230091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctctggccccctcaagatagatcgaggat

SEQ ID NO: 230092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctctgttctttttgatgtgtcgcagcttc

SEQ ID NO: 230093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctgaagtgccttccgatgggagccaggat

SEQ ID NO: 230094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctgagaggggattggcacatcgttacagg

SEQ ID NO: 230095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctgattttcggatggcggggcgtgttctt

SEQ ID NO: 230096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctgccgccgatctggattctggtactgtc

SEQ ID NO: 230097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctgctcggcttcgaccgcatcgttagcct

SEQ ID NO: 230098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctgctcttacaccgtcctggataacctac

SEQ ID NO: 230099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctgcttttttggtcaaaaccgagggtatg

SEQ ID NO: 230100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctggacgtacacgagtggcgaaagcggtg

SEQ ID NO: 230101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctggcacagtacattattgggacccgtgc

SEQ ID NO: 230102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctggcatactttcatctggcgaagatgtc

SEQ ID NO: 230103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctgggctttgaatgactgatgacgactgc

SEQ ID NO: 230104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctgggtaactcattgccacaagttttgta

SEQ ID NO: 230105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctgggttgggcgtacgatacaccggaggg

SEQ ID NO: 230106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcttccgaccctccatttgaatatggcggg

SEQ ID NO: 230107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcttcgacaggtctaggtttgacagtttgc

SEQ ID NO: 230108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcttgcagttcacaactcttgaactattca

SEQ ID NO: 230109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcttgccggtgcgccgttgagtctgccttg

SEQ ID NO: 230110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcttgtaagtactgtacttcgactaggctg

SEQ ID NO: 230111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcttgtaggtatggtattagtctgatcgct

SEQ ID NO: 230112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctttgaaataagtcccgccccgcaattgg

SEQ ID NO: 230113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgcttttcttggtatctgtccttatcgcggc

SEQ ID NO: 230114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgctttttaagggtagctattcttcactcct

SEQ ID NO: 230115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggaaaaggtacccggcgtgtgctatggtgt

SEQ ID NO: 230116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggaaatggtttggatgtgcaactctgtcaa

SEQ ID NO: 230117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggaacctccttccctcgttcggtactgccc

SEQ ID NO: 230118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggaagctgcgtattcagtccgacggctcgg

SEQ ID NO: 230119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggaatatacccgaatgctcgaaaacgaatc

SEQ ID NO: 230120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggaatgtctggctcatctccgccgtgccta

SEQ ID NO: 230121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggaatttgtgggttaactaatgccaagggc

SEQ ID NO: 230122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggacgaaccatctgaaacaaatagggttgt

SEQ ID NO: 230123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggacgggagtgtggaatcttggaccgtagg

SEQ ID NO: 230124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggactatttgagatgcccgggctactagtt

SEQ ID NO: 230125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggagagtctcgctcgcgcttccgtgctctc

SEQ ID NO: 230126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggagcgtacgactgcgctagcaaggagtcg

SEQ ID NO: 230127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggagtcaatccgcttgctagcgccgcagtg

SEQ ID NO: 230128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggatgctctgacgtttcgctactgccctgg

SEQ ID NO: 230129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggattagacgttgccggggcggtgggcttg

SEQ ID NO: 230130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggattagaggatctctgtatctggcatatg

SEQ ID NO: 230131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggattatatggcaatcccaccgaagggggg

SEQ ID NO: 230132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggatttcgggcctcagtactctgtgccacc

SEQ ID NO: 230133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggattttttgtatcagtgcatataattgga

SEQ ID NO: 230134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggcaacgtccgcggttgagagtggcgatcc

SEQ ID NO: 230135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggcaagctttttgctacaattagctgcgag

SEQ ID NO: 230136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggcaatccgacgattccagcatcacgaagt

SEQ ID NO: 230137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggcacgtccgttattcgagttgacggacaa

SEQ ID NO: 230138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggcagcttcggagccttctgagcaatggtc

SEQ ID NO: 230139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggcagtgtggtgttcttttgggtaacatga

SEQ ID NO: 230140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggcatgagttcaactacactttcactgttg

SEQ ID NO: 230141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggcatttgatacggatcgatggcgagtgtg

SEQ ID NO: 230142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggccagatccgagtagcatctccttctcat

SEQ ID NO: 230143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggccatcagaagcggatgtccttttcccta

SEQ ID NO: 230144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggccccgtattgagttcaacgttaaggccg

SEQ ID NO: 230145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggccttcattatgtcctacacgacacggtg

SEQ ID NO: 230146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggcggtatattgactatgtgtccctcttct

SEQ ID NO: 230147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggcgtttagtagactctatgcctatgagtg

SEQ ID NO: 230148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggcgtttgcccacggtagggcccggatgag

SEQ ID NO: 230149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggctaagggcactcgatactagccttcatc

SEQ ID NO: 230150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggctcggtgtaggggtgggttaggcctagg

SEQ ID NO: 230151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggctcttttgtagtacatttatacttgcgc

SEQ ID NO: 230152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggctgcctaggtgtgtaaagggcgggtgac

SEQ ID NO: 230153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggctgtctcccgtgcctttggcttcatttt

SEQ ID NO: 230154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggcttcgactagtatcgtggtgtttgagat

SEQ ID NO: 230155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggctttacggtatgtcacgttatcagtagt

SEQ ID NO: 230156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgggaatcgatggggtagcctgtatgcgctg

SEQ ID NO: 230157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgggatagggcgtaccctaggacactaggtt

SEQ ID NO: 230158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgggatgataattgagatgtcgaaggagcgc

SEQ ID NO: 230159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgggattccttacatcaattgggttattaac

SEQ ID NO: 230160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgggatttcccgggggtttacatctcgtctt

SEQ ID NO: 230161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgggcaccaagctgtgaatttcaccgctgtg

SEQ ID NO: 230162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgggctccacgctcgggggtacagcgcggct

SEQ ID NO: 230163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgggcttttacccgttctgattcaaacccta

SEQ ID NO: 230164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggggaatggggctcgtgttccattgcttgc

SEQ ID NO: 230165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggggacacacagcgacgtagccggatctcg

SEQ ID NO: 230166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggggattacggtgtgattttgtttcaagta

SEQ ID NO: 230167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggggattgagcccgtcattgtgtccgtccc

SEQ ID NO: 230168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggggcacgaccatttttacaccgtttcagt

SEQ ID NO: 230169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggggcgctaggaaaaatcagccggagcgat

SEQ ID NO: 230170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggggcggaaattactcagcaattgcgttct

SEQ ID NO: 230171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggggtagtgttttacaaagggaactcgatg

SEQ ID NO: 230172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggggtctgcggtcattcatttatgggtatg

SEQ ID NO: 230173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggggtggtatctcaaagcagtttaagctta

SEQ ID NO: 230174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggggtggtgcttatttactggagtttcata

SEQ ID NO: 230175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgggtaaaaccaatgatctaacgctgccacg

SEQ ID NO: 230176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgggtactccatggcggctggtggcttcatc

SEQ ID NO: 230177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgggtaggacattatcacgcggatgagacgc

SEQ ID NO: 230178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgggtatgctgtagtaaggcttcactgtctt

SEQ ID NO: 230179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgggtcaagcaacgatggaggtaaagcttcc

SEQ ID NO: 230180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgggtgcaggtaacactagggtgggtgcgtt

SEQ ID NO: 230181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgggtgtgcacgttgctcgcattctgatcgt

SEQ ID NO: 230182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgggttaccgtgtatattatatgtggggatg

SEQ ID NO: 230183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgggttcctgactaccgggcgtcctcgcgtc

SEQ ID NO: 230184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgggtttctaacgcggcgatgctacaccccc

SEQ ID NO: 230185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgggttttgcgaggtttgcgtgcgtccgatg

SEQ ID NO: 230186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtaaatgagtacattttgttaagtattta

SEQ ID NO: 230187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtacaccatgacgcttagaaacctggctt

SEQ ID NO: 230188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtacctgtgagcaattgtacgacctggta

SEQ ID NO: 230189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtacgggttcgtttttgcgtgccctcgaa

SEQ ID NO: 230190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtacgttagcccgcgtgctctaaccctgg

SEQ ID NO: 230191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtagaagcacatctacactgcaatgtact

SEQ ID NO: 230192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtagaatgcagttgaggaataactctatg

SEQ ID NO: 230193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtagcccagtagtcaaacctgcacgttta

SEQ ID NO: 230194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtaggattttctgggttctatatacggcc

SEQ ID NO: 230195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtataaagttgatctctactaccgtcatc

SEQ ID NO: 230196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtatgtctaatgaaccacccccgcatgtt

SEQ ID NO: 230197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtcagaggtggcgtcgacgattctgaagc

SEQ ID NO: 230198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtcaggctcgacggtggctgcatcacaaa

SEQ ID NO: 230199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtcatgcggtcgcactttgccaatacact

SEQ ID NO: 230200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtccctccctctgcgatctgaaatataag

SEQ ID NO: 230201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtcggcattgagctcaggtgattaagtgg

SEQ ID NO: 230202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtctccagtccagcagcgcaacggtgtga

SEQ ID NO: 230203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtctcttcttgggcttgaattattttata

SEQ ID NO: 230204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtcttacgaacgttcatgctgcattatac

SEQ ID NO: 230205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtcttgacttgcggggtattgcttcggca

SEQ ID NO: 230206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtctttgtttgtgtctcggttgctgccgc

SEQ ID NO: 230207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtgacagtgttaattacttttcctgttac

SEQ ID NO: 230208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtgagccataagcatatgagtaatcgagg

SEQ ID NO: 230209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtgatggggggggtgtaaaaactcatggg

SEQ ID NO: 230210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtgcataacgtcggcgcaaggggaggttg

SEQ ID NO: 230211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtgccttactgatgtggttgagtttgtat

SEQ ID NO: 230212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtgcgcagaaagtactgttgcttatctcg

SEQ ID NO: 230213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggtggtggattcgctcttaacatttgtcta

SEQ ID NO: 230214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggttaatgttactgtgtagctgcagtgcat

SEQ ID NO: 230215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggttatctgcacctgtcacgcccgcacgct

SEQ ID NO: 230216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggttctgggatatttaactggatcatggag

SEQ ID NO: 230217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttggttgcatgggggtagtgtcatcaaggata

SEQ ID NO: 230218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtaaccataatcttctaacgtagttgtact

SEQ ID NO: 230219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtaagactccgcgaggttgtatttcgttca

SEQ ID NO: 230220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtaagtagtggaaccgctagcggatgaaac

SEQ ID NO: 230221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtaagttggcgtgagctgtaaggtgggtga

SEQ ID NO: 230222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtaatactcgcgaaatgtccaagcatggcc

SEQ ID NO: 230223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtaatatctatccctacgcgcactagaacc

SEQ ID NO: 230224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtaatcagtccgataattagtaatacctgc

SEQ ID NO: 230225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtacaatctgcatactagctctaattggtt

SEQ ID NO: 230226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtacgccacggtgcagtctggatattgggc

SEQ ID NO: 230227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtactaaaaaggaacgacggtgatggtgac

SEQ ID NO: 230228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtactaccgagtgcatttcggtgcaatcgc

SEQ ID NO: 230229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtactgacgaaaattgcttctgttgatttt

SEQ ID NO: 230230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtagaactgcgagttcaacttgggcttctg

SEQ ID NO: 230231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtagcccgtttactgattctttaaaggaaa

SEQ ID NO: 230232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtaggcggacaagacagtttgtactcccca

SEQ ID NO: 230233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtaggtccattcgacaatcaggggcgggtg

SEQ ID NO: 230234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtaggtcgtaggggtggtggaacttctcct

SEQ ID NO: 230235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtatcacttcatcaattgaatgagccaaga

SEQ ID NO: 230236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtatcatgtgttgagtaatgtacagttgca

SEQ ID NO: 230237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtatcttggacgattttgtagggtgtagac

SEQ ID NO: 230238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtcaaagtccatgatgtgactatgctattt

SEQ ID NO: 230239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtcatgagcacatgcataccgaggacttac

SEQ ID NO: 230240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtccagtctcgtattcttgatttgtcttgt

SEQ ID NO: 230241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtccatgcttccacagacgctgtagtccaa

SEQ ID NO: 230242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtcccaggttcattggcgagctcggcaagg

SEQ ID NO: 230243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtcccgccacttatcgttgggatcgaattg

SEQ ID NO: 230244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtccctctattataggcctttacatcattc

SEQ ID NO: 230245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtccctgtttctcgtgcgtacgcggctgct

SEQ ID NO: 230246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtccgaatacggtcgttgcatccagcgatg

SEQ ID NO: 230247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtccgacgtggtggacagcattaccgggag

SEQ ID NO: 230248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtccgagctaaggttgatcaagaagcagga

SEQ ID NO: 230249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtccggctctatgattcgcgtacctcccgg

SEQ ID NO: 230250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtcctatatctcgagctgtccacacacaat

SEQ ID NO: 230251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtccttttcaacctcaggttaggtcaaagg

SEQ ID NO: 230252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtcgactgtttaacttgaccacctctactt

SEQ ID NO: 230253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtcggcagtgcgcggtgtaatcaacaagta

SEQ ID NO: 230254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtctaccaaaggcttaattctcgagggtta

SEQ ID NO: 230255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtctcatgtttaatagtagacgatgccttt

SEQ ID NO: 230256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtctgatgaaggataagggatctctaaaag

SEQ ID NO: 230257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtctgcctctcggtgtctaatcagtctagc

SEQ ID NO: 230258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtctggcctaggttctcacattctttgggt

SEQ ID NO: 230259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtcttagtgcctgatcgtgcatgccgacca

SEQ ID NO: 230260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtgaagccatcctgtactgcaacaaagacc

SEQ ID NO: 230261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtgaagggctattgcgatccttccctacca

SEQ ID NO: 230262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtgacttcgggacgatgtgcacctcagtcg

SEQ ID NO: 230263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtgattgtgccgcgcaatctgatgactcac

SEQ ID NO: 230264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtgcaaaaatctacaatttggcccacgcaa

SEQ ID NO: 230265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtgcaaatcatccctttgtatacctgatgg

SEQ ID NO: 230266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtgcactactgatctagtccttttgttggc

SEQ ID NO: 230267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtgcagacggttcgagatgtgctaaaagga

SEQ ID NO: 230268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtgcagtgatatgcaggtggtactttatgc

SEQ ID NO: 230269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtgcattttgaaagtctataggcaatgcca

SEQ ID NO: 230270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtgcggctcaagatcttggtccatggactg

SEQ ID NO: 230271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtgctttgggcggtgcgcgaccataaattg

SEQ ID NO: 230272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtggaatttcaagggttacgcagattgaat

SEQ ID NO: 230273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtggacgaaacgcaggccgaataagggcta

SEQ ID NO: 230274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtggcaagcgcaggagtaaacgatgctcct

SEQ ID NO: 230275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtggccccctgaacaacaagcggatttaga

SEQ ID NO: 230276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtggcctaattgctggatcttttgctcagg

SEQ ID NO: 230277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtggcgttttcgagggccataattttgtta

SEQ ID NO: 230278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtgggaaattaagggtttttgttctcatga

SEQ ID NO: 230279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtgggattaaccttggtgattatgggcatg

SEQ ID NO: 230280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtgggctcgtaaagtgactctagtgaaatt

SEQ ID NO: 230281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtgggtccaccacacatagtcctatgggtt

SEQ ID NO: 230282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtgggttttgcgccggttggattgttccga

SEQ ID NO: 230283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtggtagtgtgttcaaatgattgtctacca

SEQ ID NO: 230284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtggtcattttctcccggttcctatctgta

SEQ ID NO: 230285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtggttgtgtgcgacgttggcagctacgag

SEQ ID NO: 230286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtgtatgggagttgtaaattggtctcaccg

SEQ ID NO: 230287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtgtcctcgctgtgctcggctcaattattc

SEQ ID NO: 230288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtgtctgttctgtaacacagtacttggttg

SEQ ID NO: 230289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtgtggttggagtcgggggtgttgtacatt

SEQ ID NO: 230290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtgttatccattttttcgatacaccgctcg

SEQ ID NO: 230291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtgtttagttacgaagggttgcatggcatt

SEQ ID NO: 230292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttaattctgggacttttaaggtcgattgg

SEQ ID NO: 230293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttaattgccgctcaaatcatcaacactga

SEQ ID NO: 230294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttacggaggatttcaagttatgaccctgg

SEQ ID NO: 230295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttacttgcatttatcgagggggttaatat

SEQ ID NO: 230296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttaggcaattgcgttcgataaaacttcgg

SEQ ID NO: 230297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttatgggcttgaatctgttgagacacctg

SEQ ID NO: 230298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttatgttagcctttactcagccgttgcgt

SEQ ID NO: 230299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttattgggtgaccttcatgttcgtcatga

SEQ ID NO: 230300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttatttactacaattcagccaggaaagtc

SEQ ID NO: 230301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttatttgggcgatgtacgtcgttagagcg

SEQ ID NO: 230302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttcacgagatcgtttacgacccacggaac

SEQ ID NO: 230303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttcattctgagctcggcgatacccttctc

SEQ ID NO: 230304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttctattagcttggtgtgccagtccaggc

SEQ ID NO: 230305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttgaaggtctgggcgggggtactctccct

SEQ ID NO: 230306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttgactttgattacacccccacagattgc

SEQ ID NO: 230307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttgatcattagtacttcactgtcgctgat

SEQ ID NO: 230308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttgattacagctgaaggggctcagagttg

SEQ ID NO: 230309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttgcgtactggtcgcagtacgtgtgtgtt

SEQ ID NO: 230310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttgctaggcggcatgtcatggtgtaagtg

SEQ ID NO: 230311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttggccaatgattttttattacgacccgg

SEQ ID NO: 230312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttgtgggacggggtataaagcttcctcct

SEQ ID NO: 230313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttgttcgggaatcgttcctagaacggggt

SEQ ID NO: 230314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtttaaactatctactacctcatcatcttc

SEQ ID NO: 230315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtttcatgcggttgctcggtcgtcctacta

SEQ ID NO: 230316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtttctatacttgtaggaagtttgcttagt

SEQ ID NO: 230317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtttctgggtaccgccgataatgacgagcc

SEQ ID NO: 230318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtttgcttattcaggttcgcgataagtcgg

SEQ ID NO: 230319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtttggaatccaatcaaggttaatcgatgg

SEQ ID NO: 230320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtttgtacgagaggtcgtggaaggccttgt

SEQ ID NO: 230321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttttcagatgcggttacagaaggggaccg

SEQ ID NO: 230322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttttgatcggacctggatcgggggcggtt

SEQ ID NO: 230323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgttttgtcagggcctgatcactttttccgg

SEQ ID NO: 230324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttgtttttcttttcgacaattatacggctgct

SEQ ID NO: 230325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaaaatggcgggggtgatcaataaactctc

SEQ ID NO: 230326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaaaatgtcagggttaagttgagagcttac

SEQ ID NO: 230327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaaattcttttggtcacgggtgcgaggcgt

SEQ ID NO: 230328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaacacccgcagagactcatggcggctctc

SEQ ID NO: 230329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaacacttttgccgcacattaacgttattc

SEQ ID NO: 230330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaaccacattttattctagaggtgctcata

SEQ ID NO: 230331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaaccttatgaagaacaagtttgtggaatt

SEQ ID NO: 230332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaacttgggcgatttcttttgtcgtagtat

SEQ ID NO: 230333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaagaaggagttgctgactgggggacaact

SEQ ID NO: 230334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaagaatattcttggcgtcacaactaattt

SEQ ID NO: 230335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaagcatgccttttattcgaactccctaat

SEQ ID NO: 230336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaagctgtctcaacaaatactgttattgtc

SEQ ID NO: 230337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaaggcggttagtacgccctcgtatagcgt

SEQ ID NO: 230338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaaggtaatgaacttgacaccgtattgccc

SEQ ID NO: 230339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaaggtcgtcagttctctgagtagtggtgt

SEQ ID NO: 230340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaagtaattgaagaaacgtctggtgggttt

SEQ ID NO: 230341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaagtcctcgcttttctactcccgtctaat

SEQ ID NO: 230342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaagtcggataatagaattcacttgcttct

SEQ ID NO: 230343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaagttagttgctcgaatcgcaatagtgta

SEQ ID NO: 230344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaagtttagtcctaggggtaagctgggcgc

SEQ ID NO: 230345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaatcacgagttgacccattcaaatgcgta

SEQ ID NO: 230346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaatcactgtccgtgtgtttaatggctccg

SEQ ID NO: 230347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaatcgaagaaaccagggaacggtttgacc

SEQ ID NO: 230348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaatcgcgcttcctgtgtttatcgctggcc

SEQ ID NO: 230349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaatcgtcattccagggtatgggagccgtc

SEQ ID NO: 230350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaatctctccttaatcatgaattaaagtgt

SEQ ID NO: 230351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaatgcattacttcttgtcatggacaatga

SEQ ID NO: 230352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaatgcgccatttatcattagtatgtaccg

SEQ ID NO: 230353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaattaagtgttgcacaatccgggcacctg

SEQ ID NO: 230354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaattatgatcactttgtggggtatcgctt

SEQ ID NO: 230355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaattctattcaaactatccctcgttaagt

SEQ ID NO: 230356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaatttcattctttagttacgtgctcgggc

SEQ ID NO: 230357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaattttcgtagttgggtaaaacgaggtcg

SEQ ID NO: 230358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttacacgggcatttccaggcgttcatgctcg

SEQ ID NO: 230359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttacagacgcacagatgtagcggatcagagg

SEQ ID NO: 230360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttacatagcggtatgcgcattttaattgtac

SEQ ID NO: 230361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttacatgccatctgcgacaaagggcgccatt

SEQ ID NO: 230362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaccatctagcccgctttacgacctatctt

SEQ ID NO: 230363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaccatctgcagacaggactacttttcggt

SEQ ID NO: 230364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttacccctattgaatgcacggtctttcgtcc

SEQ ID NO: 230365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttacccgcccctgcaaattgggcgtagcacg

SEQ ID NO: 230366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaccggttacctaaaatactatcccggttt

SEQ ID NO: 230367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttacgatatagtttctcccagctgatgagct

SEQ ID NO: 230368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttacgcagacgacaactagtcgcacctgccc

SEQ ID NO: 230369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttacgcagttccaactatgtaacatgtcgtc

SEQ ID NO: 230370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttacgctggaccagcgtctactgacttgata

SEQ ID NO: 230371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttacggcctggtcagtaactgccgatcccgt

SEQ ID NO: 230372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttacgggattattgttgttgtaagaggtgcg

SEQ ID NO: 230373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttacggtagcgctttgcagattctggcttta

SEQ ID NO: 230374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttacgtatcccatcgttggtttaatgcaggc

SEQ ID NO: 230375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttacgtattttgccattcttttcgcctttgt

SEQ ID NO: 230376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttacgtgcctttaagaagagtagtagcgaaa

SEQ ID NO: 230377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttacgtgctattgtaattagccgtacatctt

SEQ ID NO: 230378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttactaggttatgtggtgcgttcatccattg

SEQ ID NO: 230379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttactatgaggcatgttctcagatgggtggc

SEQ ID NO: 230380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttactctattctgacttactttgcccagtga

SEQ ID NO: 230381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttactgcgtcatggttggagtggtaaaagga

SEQ ID NO: 230382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttactggattaccctgaggggtccattgtga

SEQ ID NO: 230383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttactggtttgtaggccacagacttgtgact

SEQ ID NO: 230384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttacttacatagaccgtccgtggctcacgga

SEQ ID NO: 230385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttacttatttaggacccttcgtcccacaatt

SEQ ID NO: 230386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttagaaggtgttcagtgccagttattgactt

SEQ ID NO: 230387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttagaatagataatgggccaatacaaacaca

SEQ ID NO: 230388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttagactgcgtttccaggcgtttgttggtca

SEQ ID NO: 230389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttagagggactgtggatactttaatgaaggg

SEQ ID NO: 230390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttagattacagagaagtccagcacggaggct

SEQ ID NO: 230391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttagattgactacctccacacttggacggtg

SEQ ID NO: 230392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttagatttccagtagtttctattggtcgagt

SEQ ID NO: 230393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttagcaggctatttcggatatgtgtagtcct

SEQ ID NO: 230394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttagccgcttccaaatctgcccttgttgtgt

SEQ ID NO: 230395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttagcgccacatgcatcggctacgttctttc

SEQ ID NO: 230396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttagctctcttcccggtgaaaatttcatgtc

SEQ ID NO: 230397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttagctgaagggctagatcattttgggtatg

SEQ ID NO: 230398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaggatctcgacacttcatttgctggaagc

SEQ ID NO: 230399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaggattgttatctaatcgagggcacctgc

SEQ ID NO: 230400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaggccctgaatattaatcgtaccgtggcc

SEQ ID NO: 230401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttagggcatgactttaagtgcatttggcgct

SEQ ID NO: 230402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaggggcggaacaaatcaactctggccatc

SEQ ID NO: 230403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttaggttcggcctgtcttattgtccaatttc

SEQ ID NO: 230404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttagtaatccggtgcatatagtcgtgttctc

SEQ ID NO: 230405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttagtaattccctgccgactttcttgagcgg

SEQ ID NO: 230406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttagtatctcatttttacgtttggaggtttg

SEQ ID NO: 230407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttagtcaatactcatgcctttattggggcaa

SEQ ID NO: 230408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttagtcctccacatgggtagaactagcggaa

SEQ ID NO: 230409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttagtcctgtgatttcgggtagggcgttcgt

SEQ ID NO: 230410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttagttacgagaactccatagattgtgatga

SEQ ID NO: 230411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttataaggcatcaatatacttggatatactt

SEQ ID NO: 230412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttataattaccccgagaattatctctagttt

SEQ ID NO: 230413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttataattaccgttacatccacactcccacg

SEQ ID NO: 230414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatacaggtgtgttacaactacgacctgca

SEQ ID NO: 230415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatagaacgaaagtacctctggccagtcct

SEQ ID NO: 230416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatagcaaggggtttccctttggggtcgcg

SEQ ID NO: 230417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatattcctaacggatgtacacttgggatc

SEQ ID NO: 230418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatatttattttaattacttacagcacgca

SEQ ID NO: 230419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatatttccaacatcataatcgtgtagaca

SEQ ID NO: 230420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatatttttatagttagtttgcttcggcct

SEQ ID NO: 230421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatcaaccgatttggacctagtgtgggttt

SEQ ID NO: 230422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatcacacgtttggggtctcacggtttttt

SEQ ID NO: 230423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatcatttggaacaaggttcctcggtattg

SEQ ID NO: 230424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatcccgggtgttagatcgtactcatccgt

SEQ ID NO: 230425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatcctttcaggcgggatttgcagcatgtt

SEQ ID NO: 230426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatcgaccggttcggagatttttgctatcg

SEQ ID NO: 230427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatcgccctagataggaaaaatgcttacag

SEQ ID NO: 230428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatcgccgattgttcccatgccgactcctt

SEQ ID NO: 230429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatcggagccaaataagacaggtacggtgc

SEQ ID NO: 230430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatcgggaacgctgctgctatgttaacttc

SEQ ID NO: 230431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatcgtgtcgtggaggtacgatgggggcgg

SEQ ID NO: 230432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatctgtccgagatccgtctgacggctgtc

SEQ ID NO: 230433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatgattatgtagttacgctactagttact

SEQ ID NO: 230434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatggcataccccaaacatcctcttggctt

SEQ ID NO: 230435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatggccttattcttgggtacgatatcgta

SEQ ID NO: 230436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatgggtaaattgtaagtccgggcgcgcta

SEQ ID NO: 230437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatgggtaattcgtcatatgagcgattgac

SEQ ID NO: 230438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatggtggcggtttgctcagtcttctctcg

SEQ ID NO: 230439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatgtcctttgggccgtcggttttcttagg

SEQ ID NO: 230440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttattaacatgcctatggcttaagtgcttga

SEQ ID NO: 230441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttattcctgtttgctatcggcctctcgcttt

SEQ ID NO: 230442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttattctgcactagttatttgtgtctcctct

SEQ ID NO: 230443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttattgattcccggttgaactaactgtaggc

SEQ ID NO: 230444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttattggcttgcgctgactaaggataaggga

SEQ ID NO: 230445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttattggtccttagttgtggcttgttttcgt

SEQ ID NO: 230446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttattgttagattaatcggatggacaggcta

SEQ ID NO: 230447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatttcgaatatcatggggattttccattt

SEQ ID NO: 230448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttatttggtcatgacttagcgctacagatta

SEQ ID NO: 230449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcaaccagcctgccggtggaaggtaatact

SEQ ID NO: 230450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcaacgaactactttaaaggtattgcctcg

SEQ ID NO: 230451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcaagattgaacgcggactggcttcgatgt

SEQ ID NO: 230452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcaagggtatgcgtaattccagttaatttg

SEQ ID NO: 230453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcaatagttataccaactgccatcatttca

SEQ ID NO: 230454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcaattcctcgcccaggctgtattgatccc

SEQ ID NO: 230455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcactgcgtgtcggaaattggtgctccggg

SEQ ID NO: 230456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcactggcgttagaacgcgagctttcgtac

SEQ ID NO: 230457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcagaacaattgacgctcattttcacgatt

SEQ ID NO: 230458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcagacgacccgaagcgggcactaaacaga

SEQ ID NO: 230459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcagccgcgttgcaattgaggacaattcct

SEQ ID NO: 230460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcaggcactgagcccggatagtagggaaaa

SEQ ID NO: 230461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcaggcatcgcaagatcactaagtccattg

SEQ ID NO: 230462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcagggcggaccccggtgaagccttccgac

SEQ ID NO: 230463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcaggggggttcttcatttcatcagggacg

SEQ ID NO: 230464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcagggtagtttctatgtcggactatgtcg

SEQ ID NO: 230465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcagtgtggttctctactcgctgtataggg

SEQ ID NO: 230466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcagtttattttatttcagctttagttata

SEQ ID NO: 230467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcatagttaccacgcgttctacactactgt

SEQ ID NO: 230468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcatcactcttattctttctcaatattagt

SEQ ID NO: 230469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcatccacataagtgtacaacgatcttgat

SEQ ID NO: 230470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcatccgaacacgtgtcaacgtagccggga

SEQ ID NO: 230471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcatccgaccgctggcgtagtaaagggaca

SEQ ID NO: 230472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcatgaatatctgtcaaggtctcacgcgga

SEQ ID NO: 230473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcatgattaacccactctggtcgtcttctt

SEQ ID NO: 230474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcatggatccttcgcattacgatcgccgtt

SEQ ID NO: 230475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcatggccaagcgctttctgcagacgggtt

SEQ ID NO: 230476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcatggtaatcggcaaagtctactcaaact

SEQ ID NO: 230477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttccaagaactgcggggtggattaaactgta

SEQ ID NO: 230478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttccaatcttagcagaacgatcagttgagtt

SEQ ID NO: 230479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttccacgattgcattctctagacgagggccc

SEQ ID NO: 230480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttccacgctcacgagattcccgttttactcg

SEQ ID NO: 230481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttccacttatcgcgcacgtgacacagtcagc

SEQ ID NO: 230482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttccccagtggcgtttcatcacttcgtggaa

SEQ ID NO: 230483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcccgcgtttataggcacagctggatccca

SEQ ID NO: 230484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttccctgcgtccttgtaccgcccatacgtac

SEQ ID NO: 230485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttccgagccgtcggagggctagtattcggac

SEQ ID NO: 230486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttccggcttactgttcgtactagatccggct

SEQ ID NO: 230487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttccggcttggttcggtattggtttgtggta

SEQ ID NO: 230488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttccgtgcaattttgtaagccattgacaact

SEQ ID NO: 230489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcctagggaatttctagaccccgacgatgc

SEQ ID NO: 230490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcctctgtgtcccgatatttaactggctgg

SEQ ID NO: 230491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcctgaccgaattgcaaatgcgttacgttc

SEQ ID NO: 230492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcctggcaatccggcctctgcttaaagtca

SEQ ID NO: 230493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcctgtaatggatcttctcaccgccgcgtc

SEQ ID NO: 230494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttccttacaactttctctcaaatttcgacac

SEQ ID NO: 230495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttccttcttgtatttatactttaattgtccc

SEQ ID NO: 230496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttccttgatttacgcacgctcagaagtaagc

SEQ ID NO: 230497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcgaaactctgtgccggctatggattgttc

SEQ ID NO: 230498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcgaattgtgccgtattagcagctacaggc

SEQ ID NO: 230499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcgacgtctcttaactgcatggatcactat

SEQ ID NO: 230500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcgatgaggtctgttttatgcgtaaggggg

SEQ ID NO: 230501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcgcacccatcgcgcggcgctttaagaatt

SEQ ID NO: 230502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcgcatatcctttccatttaatgtcaaacg

SEQ ID NO: 230503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcgccatgtattcccggtggaggcctttca

SEQ ID NO: 230504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcgcctgtgtgtctcagcttcgggctatct

SEQ ID NO: 230505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcgcctgttcccctcgttcaccacacgtac

SEQ ID NO: 230506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcggatgctttttccggatgtcgacccgta

SEQ ID NO: 230507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcggatggaagaatgtcttcttcacctagg

SEQ ID NO: 230508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcggccttcctttcggttgtgtactaatta

SEQ ID NO: 230509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcgggattcacccacgccctctatcttaat

SEQ ID NO: 230510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcggggacggttttcggtcactagtttggc

SEQ ID NO: 230511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcgggggcgcttttatcattagacctgcgt

SEQ ID NO: 230512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcgtaattattcatctatcgtgattattgg

SEQ ID NO: 230513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcgtcaccctttgtgtagtaagtgactgca

SEQ ID NO: 230514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcgtggaaccataacaggtatgagccctag

SEQ ID NO: 230515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcgttaacgtggaaaagcgtctgattgccc

SEQ ID NO: 230516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcgttcaaagccgcttatgttcccttgaaa

SEQ ID NO: 230517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcgttcagttgtgtcctacgatatttgtta

SEQ ID NO: 230518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcgttcttgcaaccgacgggctcatgtctg

SEQ ID NO: 230519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttctacgcatgcaccgtgtactcttgctatc

SEQ ID NO: 230520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttctactgagacatgaggctacccatgttag

SEQ ID NO: 230521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttctagatactgaatattgccagttaggttg

SEQ ID NO: 230522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttctagatgattaggatatgcctgtatgcgt

SEQ ID NO: 230523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttctaggttgctagcttgaccctatcgctac

SEQ ID NO: 230524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttctagttatttgaaggtaagttaggaccct

SEQ ID NO: 230525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttctcccgggacggttggttattcgatgagt

SEQ ID NO: 230526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttctccgcggtgtatgggatgagttcctttt

SEQ ID NO: 230527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttctcgcttcggtcgatcaaacaggaaagtg

SEQ ID NO: 230528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttctcggttagtttgagatacagtcgatctg

SEQ ID NO: 230529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttctcgttcctcgatagtgcgtcagtacgga

SEQ ID NO: 230530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttctctcggtagcttcttttctccgcggtgt

SEQ ID NO: 230531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttctgctttacacgaaagttgctttccagag

SEQ ID NO: 230532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttctggcgctagctgtgactctttagtctgt

SEQ ID NO: 230533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttctggttatgggggctggcggtatcttcgc

SEQ ID NO: 230534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttctgtagacgattggtaggaaatgctgcgt

SEQ ID NO: 230535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttctgtatgtctgccatcgatgcattgaagc

SEQ ID NO: 230536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttctgtgactgggttgcaatcctccatacgc

SEQ ID NO: 230537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcttacaagttttagtagattgcacatcct

SEQ ID NO: 230538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcttctcgtctctgcgaattttacatgcgt

SEQ ID NO: 230539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcttcttttgtcgttagggacggcttctgt

SEQ ID NO: 230540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttcttggttgtctgtgggccctcatccgttc

SEQ ID NO: 230541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttctttaatttccccgaacgttactaacagc

SEQ ID NO: 230542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttctttggcatcgtattctcaagcggagtgg

SEQ ID NO: 230543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttctttgtatgttagagtagtagtttggtga

SEQ ID NO: 230544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgaaattacacggtagcggcgcgttgtagg

SEQ ID NO: 230545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgaacctttctgtccacctcgcgggatcta

SEQ ID NO: 230546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgaactttagaaaccactataccgtactac

SEQ ID NO: 230547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgaagatctttgctgtatcttgcaggctgg

SEQ ID NO: 230548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgaagcggctacttggtgtggtcatcgggc

SEQ ID NO: 230549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgaagtacgtgttgcggcgtattcttggtt

SEQ ID NO: 230550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgaatgtagaaggatgccaagatattcttc

SEQ ID NO: 230551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgacacaaaggcacatgactcgtcttaatg

SEQ ID NO: 230552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgacgcctggtggaggtcatgctgcccgca

SEQ ID NO: 230553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgacgtctcacccgctaagaagccgagtag

SEQ ID NO: 230554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgactagtgtacgcgtgagaggcggccggg

SEQ ID NO: 230555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgactgtctgaagagtaggttagaaatggg

SEQ ID NO: 230556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgagagcagagcttcatggttcccggcgtg

SEQ ID NO: 230557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgagcagattttgcccaaatctccggggac

SEQ ID NO: 230558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgaggacatcgctccgcaccccatacttgg

SEQ ID NO: 230559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgaggatcaccatgacaaactcggggcttt

SEQ ID NO: 230560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgagttaacatctacgcggaacgtgcgcgc

SEQ ID NO: 230561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgatacgacataggggtctgatatacgttt

SEQ ID NO: 230562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgatgcgggatgggctttcaacaaaaagcg

SEQ ID NO: 230563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgatgctagtgttgatgttagtttcagcta

SEQ ID NO: 230564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgattgccatcttgaaatacgctcccatac

SEQ ID NO: 230565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgcaacattccgtttctcttctccgcgaaa

SEQ ID NO: 230566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgcacccccacgatatggtgttgtgttgcg

SEQ ID NO: 230567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgcactcactatgtgtaatgccgcaattct

SEQ ID NO: 230568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgcacttaatcccatcctaggacatcatta

SEQ ID NO: 230569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgcaggtagcaaacactatccggcatggct

SEQ ID NO: 230570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgcagtagtcggtagttgcggacgtggagt

SEQ ID NO: 230571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgcatcactagtagaatgttttcgcgcctg

SEQ ID NO: 230572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgcatccactgttaacatgaagtagtatgt

SEQ ID NO: 230573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgccaagtgggaaaatagctctatactgtt

SEQ ID NO: 230574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgccccgactcggacagactcatcaacacg

SEQ ID NO: 230575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgccgggatgttagagaccgagataccccg

SEQ ID NO: 230576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgcctggtccaatcacggtagttatcttgc

SEQ ID NO: 230577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgcgacgaagtcgggcttcgtgcggaaggc

SEQ ID NO: 230578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgcgcgctctttggctcgactgtttgccgt

SEQ ID NO: 230579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgcgcgttccaatgctcttccgcatgcatc

SEQ ID NO: 230580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgcgcgttgttgtgggtgaagtggggagcg

SEQ ID NO: 230581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgcggcaactcccgatcgcgtggtaggacc

SEQ ID NO: 230582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgcggccattttttaagctactagcctact

SEQ ID NO: 230583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgcggtagaacttacaaaatgccgcctgag

SEQ ID NO: 230584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgcgtagatgtccgccgtttggggttctaa

SEQ ID NO: 230585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgctcagtcaccaagtctccgagacgctcg

SEQ ID NO: 230586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgctcgctgttcatcatcttgggtacatta

SEQ ID NO: 230587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgctgaatctgcaggcccagattagttcgc

SEQ ID NO: 230588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgctgacgacttttcgttctgttcctggtt

SEQ ID NO: 230589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgctgagttcaagaacccgttatggcaaac

SEQ ID NO: 230590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgcttatgactgcgaagatagaggggtggc

SEQ ID NO: 230591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggagacaacggcctaggacacgggaaagc

SEQ ID NO: 230592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggagagatttgtatgttatggtggtgtca

SEQ ID NO: 230593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggagcgtcaaactcatgcaacatttggct

SEQ ID NO: 230594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggagtgcattgtggggtcgtgaggacact

SEQ ID NO: 230595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggagtttctacggcatccatcaacattgg

SEQ ID NO: 230596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggattttgcgcacgtagcagtattgaatt

SEQ ID NO: 230597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggcacttcacccgcaccgggcccagcttt

SEQ ID NO: 230598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggcagaggacgttgtctgttgatacgcta

SEQ ID NO: 230599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggcagcttcgaaatccgtggtgccgcgca

SEQ ID NO: 230600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggcaggccaagagtaggcgcttcgattgc

SEQ ID NO: 230601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggccagggtgacttcgctaaaggatgcat

SEQ ID NO: 230602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggcccagttaattattggtatcggcacga

SEQ ID NO: 230603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggcgctgtcgcccattgctggttggcccc

SEQ ID NO: 230604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggctactggcaccgccttgtgaaagcggc

SEQ ID NO: 230605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggctaggtattgacactgacttgcttacg

SEQ ID NO: 230606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggcttaaacctgaatacaggtacgccgca

SEQ ID NO: 230607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgggaaccgtttgattcagtccggcgtctc

SEQ ID NO: 230608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgggaaggcgtacccccaactcttccttat

SEQ ID NO: 230609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgggacactactttgacgtgtttgttcgca

SEQ ID NO: 230610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgggactacttgtacaaaggcaaggttggt

SEQ ID NO: 230611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgggagattttgcgtcttatagtgtacgct

SEQ ID NO: 230612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgggatacttgctgctatatccaacagtcc

SEQ ID NO: 230613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgggatattgaaactccgacttttgtcatg

SEQ ID NO: 230614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgggatcggtttgttggttacgaaagaccg

SEQ ID NO: 230615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgggattactttgcagcagttatttgcgga

SEQ ID NO: 230616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgggcagccacagaatgctttcggtgatgt

SEQ ID NO: 230617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgggcagctacgttaatttctttgtggacc

SEQ ID NO: 230618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgggccacgcgacagataattttccaacgt

SEQ ID NO: 230619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgggcctggtaaacgtccgagtacgcttcg

SEQ ID NO: 230620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgggcttttcacaatttttacacgctgccg

SEQ ID NO: 230621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggggcttctaagttctaatgaaacgaata

SEQ ID NO: 230622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgggggaagccaaaagttaggcatgccgcg

SEQ ID NO: 230623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggggttttaaagcattcttatttggattg

SEQ ID NO: 230624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgggtgcatacattataattttgcggggga

SEQ ID NO: 230625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgggttacgctggtttgttgacgcagcgcg

SEQ ID NO: 230626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgggttagctcttccgtggcactatcacta

SEQ ID NO: 230627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgggttctttatcatctcctagggtcgcct

SEQ ID NO: 230628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgggttgcaaaatatttccgagagataatt

SEQ ID NO: 230629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgggtttccttaacatggccggcctcgctt

SEQ ID NO: 230630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggtacgaggggaaggctgggtagatcgta

SEQ ID NO: 230631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggtagtgtgcccacactcttctccaagtc

SEQ ID NO: 230632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggtatctgtcgctagtaattggtcgtcaa

SEQ ID NO: 230633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggtatgggatagttgctcgttcagcctgg

SEQ ID NO: 230634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggtgtgttgattggatgccctcatgtatg

SEQ ID NO: 230635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggttgggctttactggcaccgtacactgc

SEQ ID NO: 230636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggtttaacatttatggcgtcaggataaca

SEQ ID NO: 230637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggtttgtttattgtttgtggagacttcaa

SEQ ID NO: 230638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttggttttttgcagaggatatttatactgtc

SEQ ID NO: 230639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgtaacacatcgtgctcacactggggttta

SEQ ID NO: 230640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgtaagacattattcaaccgatccctgaaa

SEQ ID NO: 230641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgtacaagggcagttgacgttatcgcgtcc

SEQ ID NO: 230642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgtacaataaccaatacgttcatattatga

SEQ ID NO: 230643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgtacactatgcaccccttagttccattgt

SEQ ID NO: 230644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgtaggcagacttcacgtaggcttataggc

SEQ ID NO: 230645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgtaggtgatgttaaccggctattatttgt

SEQ ID NO: 230646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgtatacgagttaagatcgaagggatacgg

SEQ ID NO: 230647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgtattttggaatggcgaacaatcggtgta

SEQ ID NO: 230648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgtcatgaaattgtacttgacggcacttac

SEQ ID NO: 230649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgtccggttgtagtttgatagtagaatttg

SEQ ID NO: 230650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgtcctagtcaggctaaacattttgggaga

SEQ ID NO: 230651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgtcgcgcacgtgacttggaatttaatggg

SEQ ID NO: 230652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgtggatgtgcttcttgggttgttagctgg

SEQ ID NO: 230653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgtggtttaccgcagttcgggtggctctgt

SEQ ID NO: 230654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgtgtcccatttcttactcttccgcttcac

SEQ ID NO: 230655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgtgtgacgccatcactgggaggggtgacg

SEQ ID NO: 230656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgtgtttctcaaggtacaggtggcgggcat

SEQ ID NO: 230657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgttcgtcctccctgatccgaatcggatca

SEQ ID NO: 230658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgttgcctgccttattactccccatatctg

SEQ ID NO: 230659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgttgcggaatagtggattacaactcggcg

SEQ ID NO: 230660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgtttctcttaatccgatcgttattcgcct

SEQ ID NO: 230661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgtttgaaggttcgtattaattcgatgcga

SEQ ID NO: 230662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgtttgatcccgccatgggaaactcggtag

SEQ ID NO: 230663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttgttttattgaaaggtatcctttatgacgc

SEQ ID NO: 230664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttaaaccaacgccatggcccatacccattg

SEQ ID NO: 230665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttaaaggtcagagggctccaggtgttggct

SEQ ID NO: 230666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttaaatcatgttctggtccagaggactgag

SEQ ID NO: 230667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttaacgacgattgcccatcggttgcactta

SEQ ID NO: 230668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttaagacaccaccgtgctcctcgcgtctgt

SEQ ID NO: 230669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttaagctaaagatcggcatgcgaatgaccc

SEQ ID NO: 230670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttaagctttagaacggctcagcctcggccc

SEQ ID NO: 230671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttaatattagtagatacgcaggcagcgctg

SEQ ID NO: 230672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttaatcgctttgatactgtactgccgtccg

SEQ ID NO: 230673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttaattccgattttctcttttattgggcct

SEQ ID NO: 230674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttaattgcttccggcgggtctgtccgcggt

SEQ ID NO: 230675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttaattgtgctgaccgaatccgcggtagtt

SEQ ID NO: 230676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttacagtatatccttgaacagtgtggattg

SEQ ID NO: 230677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttacattgcagattccgctctaattcagcc

SEQ ID NO: 230678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttacgcgatgctttggagtctggtaccttg

SEQ ID NO: 230679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttacggatgaacaggattggatactcgggg

SEQ ID NO: 230680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttacggtctaagatcgatggtcgagggatc

SEQ ID NO: 230681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttacttatttggcaccttgcgagtatggtc

SEQ ID NO: 230682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttacttcggaggcttcgtaagccccactct

SEQ ID NO: 230683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttagaatcaagctgttgcttataaatagtt

SEQ ID NO: 230684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttagagatttcctcctcgcggtcagcgcac

SEQ ID NO: 230685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttagatggactgttggatttaccagtgact

SEQ ID NO: 230686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttagcatattttagtcctggttttttctag

SEQ ID NO: 230687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttagcccaaggatgttaggactcttgtata

SEQ ID NO: 230688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttaggggctgggtatatgtttggttgagat

SEQ ID NO: 230689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttaggtaaaatttacgacggtggtattgag

SEQ ID NO: 230690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttagtacgtgaggcttcttaggttttgggg

SEQ ID NO: 230691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttagtattgggattaggtacgctacgtgtc

SEQ ID NO: 230692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttagtcttttcaccgatacgtttttgggct

SEQ ID NO: 230693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttagttttatttagtaaattttgggcaccc

SEQ ID NO: 230694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttataagaacacccgtgtttgacccgtttt

SEQ ID NO: 230695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttatagcattgcaatgtaagttgagtaact

SEQ ID NO: 230696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttatcacgctgctaccacatctctgaacat

SEQ ID NO: 230697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttatctgctgttctaatagttttaaccatt

SEQ ID NO: 230698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttatgtactcccggtttttctttccgagca

SEQ ID NO: 230699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttattaagcagctagccaccttctgccaag

SEQ ID NO: 230700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttattattatatatgttcgttaccaggatc

SEQ ID NO: 230701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttattctttcttgattttggcagatgaata

SEQ ID NO: 230702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttcaagctagcatgcaagaacgcccccgtg

SEQ ID NO: 230703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttcaagggacggttcggagtggtaacacgc

SEQ ID NO: 230704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttcaatagccatgccgatactcaagttgtt

SEQ ID NO: 230705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttcacagggactggtaattcattggggcaa

SEQ ID NO: 230706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttcaccaacggatttcttgcgttcttgtgg

SEQ ID NO: 230707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttcaccagtggcttccgactgctcaataat

SEQ ID NO: 230708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttcacggcacggttctatgtaggcacaccg

SEQ ID NO: 230709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttcactagagtatggtactttagtcgagga

SEQ ID NO: 230710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttcaggtccactgctggtgtggattactgc

SEQ ID NO: 230711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttcatggagttcatgataagtccccatgtg

SEQ ID NO: 230712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttcatgtgagcaagagcatcgtgcaggact

SEQ ID NO: 230713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttcattatgactagagggacaggcccgttt

SEQ ID NO: 230714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttccaaatcggcggaggctagaagaagtcg

SEQ ID NO: 230715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttccagcttggtactgcgaaatttttattc

SEQ ID NO: 230716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttccccgcaaacgttgttcagttcacttct

SEQ ID NO: 230717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttccttcgatcaaagccattacgaacaggt

SEQ ID NO: 230718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttccttgagaggacagcagattcttggtgc

SEQ ID NO: 230719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttcgagcgccataaatgataaaagcatgcg

SEQ ID NO: 230720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttcgaggcatacgcgaaacggcacagtttg

SEQ ID NO: 230721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttcgataatccgcggggaaacgggccaccg

SEQ ID NO: 230722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttcgatttgattcgcggccggtgagtggga

SEQ ID NO: 230723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttcgcagttttggctctcggttctgctgct

SEQ ID NO: 230724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttcgcggagttactccaaagggtcattatg

SEQ ID NO: 230725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttctagatgactcttttaggagaaatttca

SEQ ID NO: 230726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttctatctttacacgttagtatatcaatgt

SEQ ID NO: 230727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttctctactcttgggccggctatgttgggg

SEQ ID NO: 230728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttctctgtgacccttcgagtcctctcgatt

SEQ ID NO: 230729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttctgggatttgcgatgcaatgagtcgctc

SEQ ID NO: 230730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttcttcaatgttagacagtataactatgga

SEQ ID NO: 230731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttcttcctaggctttccccaactctgattt

SEQ ID NO: 230732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttcttgcttggtacctgtttttacacagca

SEQ ID NO: 230733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttctttccaagctaagtatgaacgctccgt

SEQ ID NO: 230734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttctttccgcactctcctgtcacttatctt

SEQ ID NO: 230735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttctttgttggcattgtttaaatttttggt

SEQ ID NO: 230736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgaagcatacgtaaacgaagaccgtgttt

SEQ ID NO: 230737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgaagggttcacttattgtgtagtctcga

SEQ ID NO: 230738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgaattttaatatctctgaattcccacct

SEQ ID NO: 230739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgacgattcttagtatagtttgagaggtc

SEQ ID NO: 230740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgcaaatcgcatattttatgatttagagc

SEQ ID NO: 230741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgcaccccagcagaacgaaatttgggccc

SEQ ID NO: 230742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgcagctaatgttcaggttttttagctta

SEQ ID NO: 230743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgcagttgctactatatgggtgcggttta

SEQ ID NO: 230744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgcatagatggaatatcgcttctgtgtta

SEQ ID NO: 230745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgccactaagctagttctagaccacgtta

SEQ ID NO: 230746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgcccagagggatgcgtttgaaaatatag

SEQ ID NO: 230747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgcccatgtccaaaagggatatctcctta

SEQ ID NO: 230748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgcggttgaaggtgagcataacagtgtgc

SEQ ID NO: 230749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgctcggctgcgtgtatcactgtttcgac

SEQ ID NO: 230750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgctgatcggtcggcgtgccctgtccgag

SEQ ID NO: 230751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgctttaaacaaacgcgtagttccagttg

SEQ ID NO: 230752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgcttttttcaactctcgtagaactggta

SEQ ID NO: 230753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttggagggtgcttacttgtgtgtggggatt

SEQ ID NO: 230754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttggatgtaacggtaaaactaatgatccat

SEQ ID NO: 230755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttggcatatgccttcgatctgtctccgtca

SEQ ID NO: 230756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttggcggacagtcgctgatgaacgcttctg

SEQ ID NO: 230757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgggtgaattccgtttaaaacgtcacgct

SEQ ID NO: 230758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgggtggaataaatttcttggctacgggc

SEQ ID NO: 230759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgggtgtgtccaattgccgtctgatctcc

SEQ ID NO: 230760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttggtcgcgtcacgaaatgtttgactgtcc

SEQ ID NO: 230761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttggtcttaggttattagagaatcggtagg

SEQ ID NO: 230762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgtaggtcgagcaaaaacggggcgcccgt

SEQ ID NO: 230763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgtccgatgcgagatcccattggtctgat

SEQ ID NO: 230764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgtgcaagcgttcatgggcgcttcttagc

SEQ ID NO: 230765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgtgttagtcccctggttctgcctcagta

SEQ ID NO: 230766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgttctccggcttacgctgttcatctttg

SEQ ID NO: 230767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgttggtttcggggttatgcgtgtgtggg

SEQ ID NO: 230768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgttgttggttcttgtaacgtgcgggtgc

SEQ ID NO: 230769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttgttttcggccattatttgacatcactcc

SEQ ID NO: 230770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttaatttgaaaatgagtgcgagtttcaac

SEQ ID NO: 230771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttacgtcggcctggaagtatggatagcac

SEQ ID NO: 230772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttacttctagtccaggagaattctacgct

SEQ ID NO: 230773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttagggatgttgccgaccagacccgtagg

SEQ ID NO: 230774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttatacttgatccttgatgcgtcttagca

SEQ ID NO: 230775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttatataaatctcaatgtgcatcttgtgg

SEQ ID NO: 230776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttatattttgactcgcatttcctagggtt

SEQ ID NO: 230777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttatcatcagtcctcttaccgaccggcac

SEQ ID NO: 230778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttattcttttcggtaaactcacttgtaag

SEQ ID NO: 230779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttcactatcaacgcggaggttagccctaa

SEQ ID NO: 230780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttccacgcgctcatccacaatcctaaact

SEQ ID NO: 230781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttccagctaaggggattccttaagtctgc

SEQ ID NO: 230782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttcccctacagtactcctgctccctcgaa

SEQ ID NO: 230783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttcctctgaagtagaacgggtgcggttcc

SEQ ID NO: 230784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttccttggacgcatctatgctaagcacac

SEQ ID NO: 230785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttcgattctacatgatagggggtgacatt

SEQ ID NO: 230786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttcgcactattatggacttagcgcgcaca

SEQ ID NO: 230787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttctcattatgagagtagcaatgactgta

SEQ ID NO: 230788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttctcccccattgcatcgcggaatatggg

SEQ ID NO: 230789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttctccgtagaaatgcctcacccggttga

SEQ ID NO: 230790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttctgtagagtgggaatgtgttgagttgc

SEQ ID NO: 230791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttcttatacacgttttctgtcacaaatct

SEQ ID NO: 230792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttgagttacttttttacttcatgcaatcg

SEQ ID NO: 230793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttggcgtgtggaatgagttagaagaattg

SEQ ID NO: 230794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttgtggttccattctacggggggtgatca

SEQ ID NO: 230795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttgtgtgcaacatgttattccgacagcct

SEQ ID NO: 230796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttgttgatgttctccactttcgggatgta

SEQ ID NO: 230797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttgttgctatcccggacggagataggaag

SEQ ID NO: 230798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttttaagcgcgcacccagttagattcgatc

SEQ ID NO: 230799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttttacatgtccttgatttgtcgacggaca

SEQ ID NO: 230800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttttatataggtatgttattccccaagctt

SEQ ID NO: 230801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttttattgcgaggaagacggttacaggagc

SEQ ID NO: 230802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttttccatgtttccattttcacggtggtta

SEQ ID NO: 230803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttttgatcatagaacttgctgctgtcaatg

SEQ ID NO: 230804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttttaatttcagattgttggaaggtttcg

SEQ ID NO: 230805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttttatgcggatggcatgaattatcggcc

SEQ ID NO: 230806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttttccgagttcgattaaatcctcggcgc

SEQ ID NO: 230807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttttgccaacacccgcacgattgtcggtt

SEQ ID NO: 230808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tttttttggtcgaaattgtggctacagaaggc

SEQ ID NO: 230809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ttttttttccctatattgaaagtacggccact

SEQ ID NO: 230810 - DNA, 32 bp, Artificial Sequence; identical to SEQ ID NO: 183212
  Synthetic oligonucleotide
  source (1)..(32): /organism="Artificial Sequence" /note="Description of Artificial Sequence: Synthetic oligonucleotide" /mol_type="unassigned DNA"

SEQ ID NO: 230811 - DNA, 34 bp, Artificial Sequence
  Synthetic oligonucleotide
  source (1)..(34): /organism="Artificial Sequence" /note="Description of Artificial Sequence: Synthetic oligonucleotide" /mol_type="unassigned DNA"
aatcgttagtcactattcgtccatagtagtgaca

SEQ ID NO: 230812 - DNA, 31 bp, Artificial Sequence
  Synthetic oligonucleotide
  source (1)..(31): /organism="Artificial Sequence" /note="Description of Artificial Sequence: Synthetic oligonucleotide" /mol_type="unassigned DNA"
tttcaaggcactcgtgttcccgacatgagtg

SEQ ID NO: 230813 - DNA, 18 bp, Artificial Sequence
  Synthetic oligonucleotide
  source (1)..(18): /organism="Artificial Sequence" /note="Description of Artificial Sequence: Synthetic oligonucleotide" /mol_type="unassigned DNA"
atccagagtgacgcagca

SEQ ID NO: 230814 - DNA, 18 bp, Artificial Sequence
  Synthetic oligonucleotide
  source (1)..(18): /organism="Artificial Sequence" /note="Description of Artificial Sequence: Synthetic oligonucleotide" /mol_type="unassigned DNA"
actaagccaccgtgtcca

SEQ ID NO: 230815 - DNA, 18 bp, Artificial Sequence
  Synthetic oligonucleotide
  source (1)..(18): /organism="Artificial Sequence" /note="Description of Artificial Sequence: Synthetic oligonucleotide" /mol_type="unassigned DNA"
atccagagtgacgcagca

SEQ ID NO: 230816 - DNA, 18 bp, Artificial Sequence
  Synthetic oligonucleotide
  source (1)..(18): /organism="Artificial Sequence" /note="Description of Artificial Sequence: Synthetic oligonucleotide" /mol_type="unassigned DNA"
actaagccaccgtgtcca

SEQ ID NO: 230817 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
  site (19)..(38): n = a, g, c, t/u, unknown or other
  misc_feature (19)..(38): n is a, c, g, or t
atccagagtgacgcagcannnnnnnnnnnnnnnnnnnntggacacggtggcttagt

SEQ ID NO: 230818 - DNA, 61 bp, Artificial Sequence
  Synthetic oligonucleotide
  source (1)..(61): /organism="Artificial Sequence" /note="Description of Artificial Sequence: Synthetic oligonucleotide" /mol_type="unassigned DNA"
  site (19)..(43): n = a, g, c, t/u, unknown or other
  misc_feature (19)..(43): n is a, c, g, or t
atccagagtgacgcagcannnnnnnnnnnnnnnnnnnnnnnnntggacacggtggcttagt

SEQ ID NO: 230819 - DNA, 66 bp, Artificial Sequence
  Synthetic oligonucleotide
  source (1)..(66): /organism="Artificial Sequence" /note="Description of Artificial Sequence: Synthetic oligonucleotide" /mol_type="unassigned DNA"
  site (19)..(48): n = a, g, c, t/u, unknown or other
  misc_feature (19)..(48): n is a, c, g, or t
atccagagtgacgcagcannnnnnnnnnnnnnnnnnnnnnnnnnnnnntggacacggtggcttagt

SEQ ID NO: 230820 - DNA, 71 bp, Artificial Sequence
  Synthetic oligonucleotide
  source (1)..(71): /organism="Artificial Sequence" /note="Description of Artificial Sequence: Synthetic oligonucleotide" /mol_type="unassigned DNA"
  site (19)..(53): n = a, g, c, t/u, unknown or other
  misc_feature (19)..(53): n is a, c, g, or t
atccagagtgacgcagcannnnnnnnnnnnnnnnnnnnnnnnnnnnnnnnnnntggacacggtggcttagt

SEQ ID NO: 230821 - DNA, 76 bp, Artificial Sequence
  Synthetic oligonucleotide
  source (1)..(76): /organism="Artificial Sequence" /note="Description of Artificial Sequence: Synthetic oligonucleotide" /mol_type="unassigned DNA"
  site (19)..(58): n = a, g, c, t/u, unknown or other
  misc_feature (19)..(58): n is a, c, g, or t
atccagagtgacgcagcannnnnnnnnnnnnnnnnnnnnnnnnnnnnnnnnnnnnnnntggacacggtggcttagt

SEQ ID NO: 230822 - DNA, 70 bp, Artificial Sequence
  Synthetic oligonucleotide
  source (1)..(70): /organism="Artificial Sequence" /note="Description of Artificial Sequence: Synthetic oligonucleotide" /mol_type="unassigned DNA"
atccagagtgacgcagcagtcttttctgatggacacgtggtggtctagtatctggacacggtggcttagt

SEQ ID NO: 230823 - DNA, 70 bp, Artificial Sequence; identical to SEQ ID NO: 230822
  Synthetic oligonucleotide
  source (1)..(70): /organism="Artificial Sequence" /note="Description of Artificial Sequence: Synthetic oligonucleotide" /mol_type="unassigned DNA"

SEQ ID NO: 230824 - DNA, 76 bp, Artificial Sequence
  Synthetic oligonucleotide
  source (1)..(76): /organism="Artificial Sequence" /note="Description of Artificial Sequence: Synthetic oligonucleotide" /mol_type="unassigned DNA"
atccagagtgacgcagcatcccccccgatccccgaccataccatgaatgtattatctttggacacggtggcttagt

SEQ ID NO: 230825 - DNA, 76 bp, Artificial Sequence; identical to SEQ ID NO: 230824
  Synthetic oligonucleotide
  source (1)..(76): /organism="Artificial Sequence" /note="Description of Artificial Sequence: Synthetic oligonucleotide" /mol_type="unassigned DNA"

SEQ ID NO: 230826 - DNA, 71 bp, Artificial Sequence
  Synthetic oligonucleotide
  source (1)..(71): /organism="Artificial Sequence" /note="Description of Artificial Sequence: Synthetic oligonucleotide" /mol_type="unassigned DNA"
atccagagtgacgcagcataacccgcaaccacccatcactgcctgctactatatggacacggtggcttagt

SEQ ID NO: 230827 - DNA, 71 bp, Artificial Sequence; identical to SEQ ID NO: 230826
  Synthetic oligonucleotide
  source (1)..(71): /organism="Artificial Sequence" /note="Description of Artificial Sequence: Synthetic oligonucleotide" /mol_type="unassigned DNA"

SEQ ID NO: 230828 - DNA, 61 bp, Artificial Sequence
  Synthetic oligonucleotide
  source (1)..(61): /organism="Artificial Sequence" /note="Description of Artificial Sequence: Synthetic oligonucleotide" /mol_type="unassigned DNA"
atccagagtgacgcagcatgtgatgaggggggttttcgataggtggacacggtggcttagt

SEQ ID NO: 230829 - DNA, 61 bp, Artificial Sequence; identical to SEQ ID NO: 230828
  Synthetic oligonucleotide
  source (1)..(61): /organism="Artificial Sequence" /note="Description of Artificial Sequence: Synthetic oligonucleotide" /mol_type="unassigned DNA"

SEQ ID NO: 230830 - DNA, 71 bp, Artificial Sequence
  Synthetic oligonucleotide
  source (1)..(71): /organism="Artificial Sequence" /note="Description of Artificial Sequence: Synthetic oligonucleotide" /mol_type="unassigned DNA"
atccagagtgacgcagcaccaccacccgcctactgctagttacttgggtagtttggacacggtggcttagt

SEQ ID NO: 230831 - DNA, 71 bp, Artificial Sequence; identical to SEQ ID NO: 230830
  Synthetic oligonucleotide
  source (1)..(71): /organism="Artificial Sequence" /note="Description of Artificial Sequence: Synthetic oligonucleotide" /mol_type="unassigned DNA"

SEQ ID NO: 230832 - DNA, 71 bp, Artificial Sequence
  Synthetic oligonucleotide
  source (1)..(71): /organism="Artificial Sequence" /note="Description of Artificial Sequence: Synthetic oligonucleotide" /mol_type="unassigned DNA"
atccagagtgacgcagcattggaccgggggcttggcaatttcgacctaacatctggacacggtggcttagt

SEQ ID NO: 230833 - DNA, 71 bp, Artificial Sequence; identical to SEQ ID NO: 230832
  Synthetic oligonucleotide
  source (1)..(71): /organism="Artificial Sequence" /note="Description of Artificial Sequence: Synthetic oligonucleotide" /mol_type="unassigned DNA"

SEQ ID NO: 230834 - DNA, 71 bp, Artificial Sequence
  Synthetic oligonucleotide
  source (1)..(71): /organism="Artificial Sequence" /note="Description of Artificial Sequence: Synthetic oligonucleotide" /mol_type="unassigned DNA"
atccagagtgacgcagcaggagagggtggcttagggaggtgcaagaaggtagatggacacggtggcttagt

SEQ ID NO: 230835 - DNA, 71 bp, Artificial Sequence; identical to SEQ ID NO: 230834
  Synthetic oligonucleotide
  source (1)..(71): /organism="Artificial Sequence" /note="Description of Artificial Sequence: Synthetic oligonucleotide" /mol_type="unassigned DNA"

SEQ ID NO: 230836 - DNA, 71 bp, Artificial Sequence
  Synthetic oligonucleotide
  source (1)..(71): /organism="Artificial Sequence" /note="Description of Artificial Sequence: Synthetic oligonucleotide" /mol_type="unassigned DNA"
atccagagtgacgcagcacatgcggcattctgagtctggtgcgactttctggttggacacggtggcttagt

SEQ ID NO: 230837 - DNA, 71 bp, Artificial Sequence; identical to SEQ ID NO: 230836
  Synthetic oligonucleotide
  source (1)..(71): /organism="Artificial Sequence" /note="Description of Artificial Sequence: Synthetic oligonucleotide" /mol_type="unassigned DNA"

SEQ ID NO: 230838 - DNA, 71 bp, Artificial Sequence
  Synthetic oligonucleotide
  source (1)..(71): /organism="Artificial Sequence" /note="Description of Artificial Sequence: Synthetic oligonucleotide" /mol_type="unassigned DNA"
atccagagtgacgcagcagatgaatttgtatttggacgcggtggtggtaatcatggacacggtggcttagt

SEQ ID NO: 230839 - DNA, 71 bp, Artificial Sequence; identical to SEQ ID NO: 230838
  Synthetic oligonucleotide
  source (1)..(71): /organism="Artificial Sequence" /note="Description of Artificial Sequence: Synthetic oligonucleotide" /mol_type="unassigned DNA"

SEQ ID NO: 230840 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccaacgtaagtatatctgtacaatgctgcgtcactctggat

SEQ ID NO: 230841 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccaaacatcagcttttatcttaatgctgcgtcactctggat

SEQ ID NO: 230842 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccatgttataacctaccattaaatgctgcgtcactctggat

SEQ ID NO: 230843 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccaaccgtatggttatgtgctcatgctgcgtcactctggat

SEQ ID NO: 230844 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccaccatacgtcacacttctttatgctgcgtcactctggat

SEQ ID NO: 230845 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccaggtccatctccttacatttttgctgcgtcactctggat

SEQ ID NO: 230846 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccactatgtaccaactatttatatgctgcgtcactctggat

SEQ ID NO: 230847 - RNA, 70 nt, Artificial Sequence
  Synthetic oligonucleotide
  source (1)..(70): /organism="Artificial Sequence" /note="Description of Artificial Sequence: Synthetic oligonucleotide" /mol_type="unassigned RNA"
auccagagugacgcagcagucuuuucugauggacacgugguggucuaguaucacuaagccaccgugucca

SEQ ID NO: 230848 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
acgtaagtatatctgtacaa

SEQ ID NO: 230849 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
accgtatggttatgtgctca

SEQ ID NO: 230850 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
acgtaagtatatctgcacaa

SEQ ID NO: 230851 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
accgtatgtttatgtgctca

SEQ ID NO: 230852 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
acgtaagtatatctgtacag

SEQ ID NO: 230853 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
accgtaagtatatctgtaca

SEQ ID NO: 230854 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
ccgtaagtatatctgtacaa

SEQ ID NO: 230855 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
acgtaagtatatctgtacac

SEQ ID NO: 230856 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
atcgtaagtatatctgtaca

SEQ ID NO: 230857 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
acgtatgtatatctgtacaa

SEQ ID NO: 230858 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
acgtaagtatatgtgtacaa

SEQ ID NO: 230859 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
aacgtaagtatatctgtaca

SEQ ID NO: 230860 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
gcgtaagtatatctgtacaa

SEQ ID NO: 230861 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
tcgtaagtatatctgtacaa

SEQ ID NO: 230862 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
acgtaagtatatctgtacat

SEQ ID NO: 230863 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
acgtatggttatgtgctcaa

SEQ ID NO: 230864 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
acgtaagtatatctgttcaa

SEQ ID NO: 230865 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
accgtatggttatctgctca

SEQ ID NO: 230866 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
aacgtatggttatgtgctca

SEQ ID NO: 230867 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
gccgtatggttatgtgctca

SEQ ID NO: 230868 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
accgtatggttatgtgttca

SEQ ID NO: 230869 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
acgtaagtatatctgttcaa

SEQ ID NO: 230870 - DNA, 18 bp, Artificial Sequence
  Synthetic oligonucleotide
  source (1)..(18): /organism="Artificial Sequence" /note="Description of Artificial Sequence: Synthetic oligonucleotide" /mol_type="unassigned DNA"
cgtawgkwtatstgywca

SEQ ID NO: 230871 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccaacacaagtatatctgtacaatgctgcgtcactctggat

SEQ ID NO: 230872 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccaacgtaaatatatctgtacaatgctgcgtcactctggat

SEQ ID NO: 230873 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccaacgtaagtagcgctgtacaatgctgcgtcactctggat

SEQ ID NO: 230874 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccaacgtaagtatatccatacaatgctgcgtcactctggat

SEQ ID NO: 230875 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccaacgtaagtatatctgtatcatgctgcgtcactctggat

SEQ ID NO: 230876 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccaacacaaatagcgccatatcatgctgcgtcactctggat

SEQ ID NO: 230877 - DNA, 38 bp, Artificial Sequence
  Synthetic oligonucleotide
  source (1)..(38): /organism="Artificial Sequence" /note="Description of Artificial Sequence: Synthetic oligonucleotide" /mol_type="unassigned DNA"
actaagccaccgtgtccaacgtaagtatatctgtacaa

SEQ ID NO: 230878 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccaaaaaaagggtcttctacggttgctgcgtcactctggat

SEQ ID NO: 230879 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccaacgtacgtatatctgtacaatgctgcgtcactctggat

SEQ ID NO: 230880 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccaacgtaagactatctgtacaatgctgcgtcactctggat

SEQ ID NO: 230881 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccaacgtaagtatatatgtacaatgctgcgtcactctggat

SEQ ID NO: 230882 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccaacgtaagtatatctggccaatgctgcgtcactctggat

SEQ ID NO: 230883 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
acgtaagtatatctgtacaa

SEQ ID NO: 230884 - DNA, 38 bp, Artificial Sequence
  Synthetic oligonucleotide
  source (1)..(38): /organism="Artificial Sequence" /note="Description of Artificial Sequence: Synthetic oligonucleotide" /mol_type="unassigned DNA"
ccgtgtccaacgtaagtatatctgtacaatgctgcgtc

SEQ ID NO: 230885 - DNA, 55 bp, Artificial Sequence
  Synthetic oligonucleotide
  source (1)..(55): /organism="Artificial Sequence" /note="Description of Artificial Sequence: Synthetic oligonucleotide" /mol_type="unassigned DNA"
actaagccaccgtgtccaacgtaagtatatctgtacaatgctgcgtcactctgga

SEQ ID NO: 230886 - DNA, 38 bp, Artificial Sequence
  Synthetic oligonucleotide
  source (1)..(38): /organism="Artificial Sequence" /note="Description of Artificial Sequence: Synthetic oligonucleotide" /mol_type="unassigned DNA"
acgtaagtatatctgtacaatgctgcgtcactctggat

SEQ ID NO: 230887 - DNA, 38 bp, Artificial Sequence; identical to SEQ ID NO: 230886
  Synthetic oligonucleotide
  source (1)..(38): /organism="Artificial Sequence" /note="Description of Artificial Sequence: Synthetic oligonucleotide" /mol_type="unassigned DNA"

SEQ ID NO: 230888 - DNA, 56 bp, Artificial Sequence; identical to SEQ ID NO: 230840
  Synthetic oligonucleotide
  source (1)..(56): /organism="Artificial Sequence" /note="Description of Artificial Sequence: Synthetic oligonucleotide" /mol_type="unassigned DNA"

SEQ ID NO: 230889 - DNA, 56 bp, Artificial Sequence; identical to SEQ ID NO: 230840
  Synthetic oligonucleotide
  source (1)..(56): /organism="Artificial Sequence" /note="Description of Artificial Sequence: Synthetic oligonucleotide" /mol_type="unassigned DNA"

SEQ ID NO: 230890 - DNA, 56 bp, Artificial Sequence; identical to SEQ ID NO: 230840
  Synthetic oligonucleotide
  source (1)..(56): /organism="Artificial Sequence" /note="Description of Artificial Sequence: Synthetic oligonucleotide" /mol_type="unassigned DNA"

SEQ ID NO: 230891 - DNA, 56 bp, Artificial Sequence; identical to SEQ ID NO: 230840
  Synthetic oligonucleotide
  source (1)..(56): /organism="Artificial Sequence" /note="Description of Artificial Sequence: Synthetic oligonucleotide" /mol_type="unassigned DNA"

SEQ ID NO: 230892 - DNA, 56 bp, Artificial Sequence; identical to SEQ ID NO: 230840
  Synthetic oligonucleotide
  source (1)..(56): /organism="Artificial Sequence" /note="Description of Artificial Sequence: Synthetic oligonucleotide" /mol_type="unassigned DNA"

SEQ ID NO: 230893 - DNA, 55 bp, Artificial Sequence
  Synthetic oligonucleotide
  source (1)..(55): /organism="Artificial Sequence" /note="Description of Artificial Sequence: Synthetic oligonucleotide" /mol_type="unassigned DNA"
actaagccaccgtgtccaacgtagtatatctgtacaatgctgcgtcactctggat

SEQ ID NO: 230894 - DNA, 51 bp, Artificial Sequence
  Synthetic oligonucleotide
  source (1)..(51): /organism="Artificial Sequence" /note="Description of Artificial Sequence: Synthetic oligonucleotide" /mol_type="unassigned DNA"
actaagccaccgtgacgtagtatatctgtacaatgctgcgtcactctggat

SEQ ID NO: 230895 - DNA, 51 bp, Artificial Sequence
  Synthetic oligonucleotide
  source (1)..(51): /organism="Artificial Sequence" /note="Description of Artificial Sequence: Synthetic oligonucleotide" /mol_type="unassigned DNA"
actaatccaccgtgacgtagtatatctgtacaatgctgcgtcactctggat

SEQ ID NO: 230896 - DNA, 51 bp, Artificial Sequence
  Synthetic oligonucleotide
  source (1)..(51): /organism="Artificial Sequence" /note="Description of Artificial Sequence: Synthetic oligonucleotide" /mol_type="unassigned DNA"
actaatccagagtgacgtagtatatctgtacaatgctgcgtcactctggat

SEQ ID NO: 230897 - DNA, 51 bp, Artificial Sequence
  Synthetic oligonucleotide
  source (1)..(51): /organism="Artificial Sequence" /note="Description of Artificial Sequence: Synthetic oligonucleotide" /mol_type="unassigned DNA"
actaatccagagtgacgtagtatatctgtactatgctgcgtcactctggat

SEQ ID NO: 230898 - DNA, 29 bp, Artificial Sequence
  Synthetic oligonucleotide
  source (1)..(29): /organism="Artificial Sequence" /note="Description of Artificial Sequence: Synthetic oligonucleotide" /mol_type="unassigned DNA"
gacgtagtatatctgtacaatgctgcgtc

SEQ ID NO: 230899 - DNA, 28 bp, Artificial Sequence
  Synthetic oligonucleotide
  source (1)..(28): /organism="Artificial Sequence" /note="Description of Artificial Sequence: Synthetic oligonucleotide" /mol_type="unassigned DNA"
acgtaagtatatctgtacaatgctgcgt

SEQ ID NO: 230900 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccatctttcgtcttgttatgtattgctgcgtcactctggat

SEQ ID NO: 230901 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccatgttttccttcttacctttatgctgcgtcactctggat

SEQ ID NO: 230902 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccaacctactatccattaatttttgctgcgtcactctggat

SEQ ID NO: 230903 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccaatgttttccctgttattttttgctgcgtcactctggat

SEQ ID NO: 230904 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccagtgtcccctcctatagctgctgctgcgtcactctggat

SEQ ID NO: 230905 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccagcgttcccctactatttaactgctgcgtcactctggat

SEQ ID NO: 230906 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccatcctggttatactccccttctgctgcgtcactctggat

SEQ ID NO: 230907 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccatatcgctgtttcctgttatctgctgcgtcactctggat

SEQ ID NO: 230908 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccacctattattagcttttcttttgctgcgtcactctggat

SEQ ID NO: 230909 - DNA, 27 bp, Artificial Sequence
  Synthetic oligonucleotide
  source (1)..(27): /organism="Artificial Sequence" /note="Description of Artificial Sequence: Synthetic oligonucleotide" /mol_type="unassigned DNA"
tatcgctgtttcctgttatctgctgcg

SEQ ID NO: 230910 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccagtgtcccctcctatagctgctgctgcgtcactctgg

SEQ ID NO: 230911 - DNA, 28 bp, Artificial Sequence
  Synthetic oligonucleotide
  source (1)..(28): /organism="Artificial Sequence" /note="Description of Artificial Sequence: Synthetic oligonucleotide" /mol_type="unassigned DNA"
ccagcgttcccctactatttaactgctg

SEQ ID NO: 230912 - DNA, 26 bp, Artificial Sequence
  Synthetic oligonucleotide
  source (1)..(26): /organism="Artificial Sequence" /note="Description of Artificial Sequence: Synthetic oligonucleotide" /mol_type="unassigned DNA"
caattgggcccgtccgtatggtgggt

SEQ ID NO: 230913 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccataacactatgtcagttagtatgctgcgtcactctggat

SEQ ID NO: 230914 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccacttgaaatgtgattctttattgctgcgtcactctggat

SEQ ID NO: 230915 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccattccttgtctcctattcatttgctgcgtcactctggat

SEQ ID NO: 230916 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccatctctatattacatgcttcttgctgcgtcactctggat

SEQ ID NO: 230917 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccaccctttttgcgatttctttatgctgcgtcactctggat

SEQ ID NO: 230918 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccagaagtaagatccttctgatatgctgcgtcactctggat

SEQ ID NO: 230919 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccaaccttgttgtatccgttatatgctgcgtcactctggat

SEQ ID NO: 230920 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccattgccttttcaaagtaatattgctgcgtcactctggat

SEQ ID NO: 230921 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccatattcccatgtcatataccttgctgcgtcactctggat

SEQ ID NO: 230922 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccattgcatagcatattatcttctgctgcgtcactctggat

SEQ ID NO: 230923 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccattgttactctgtatctttattgctgcgtcactctggat

SEQ ID NO: 230924 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccattctttactcttttcttttttgctgcgtcactctggat

SEQ ID NO: 230925 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccatcgtttcttcttcactttattgctgcgtcactctggat

SEQ ID NO: 230926 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccatgtttccttctgttatcttatgctgcgtcactctggat

SEQ ID NO: 230927 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccattctcttgctctctttctcttgctgcgtcactctggat

SEQ ID NO: 230928 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccaccttcactccgttattcctgtgctgcgtcactctggat

SEQ ID NO: 230929 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
tgctgcgtcactctggatccttcactccgttattcctgactaagccaccgtgtcca

SEQ ID NO: 230930 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
actaagccaccgtgtccactttacttactcctttgttttgctgcgtcactctggat

SEQ ID NO: 230931 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
tgctgcgtcactctggatctttacttactcctttgtttactaagccaccgtgtcca

SEQ ID NO: 230932 - DNA, 66 bp, Artificial Sequence
  Synthetic oligonucleotide
  source (1)..(66): /organism="Artificial Sequence" /note="Description of Artificial Sequence: Synthetic oligonucleotide" /mol_type="unassigned DNA"
actaagccaccgtgtccacccccctctgtctcttgtttctcttttctatgctgcgtcactctggat

SEQ ID NO: 230933 - DNA, 66 bp, Artificial Sequence
  Synthetic oligonucleotide
  source (1)..(66): /organism="Artificial Sequence" /note="Description of Artificial Sequence: Synthetic oligonucleotide" /mol_type="unassigned DNA"
actaagccaccgtgtccagccctattccctcgctttctccccttttgttgctgcgtcactctggat

SEQ ID NO: 230934 - DNA, 66 bp, Artificial Sequence
  Synthetic oligonucleotide
  source (1)..(66): /organism="Artificial Sequence" /note="Description of Artificial Sequence: Synthetic oligonucleotide" /mol_type="unassigned DNA"
actaagccaccgtgtccacccgcctgatccaaagtactgactctgttatgctgcgtcactctggat

SEQ ID NO: 230935 - DNA, 66 bp, Artificial Sequence
  Synthetic oligonucleotide
  source (1)..(66): /organism="Artificial Sequence" /note="Description of Artificial Sequence: Synthetic oligonucleotide" /mol_type="unassigned DNA"
actaagccaccgtgtccacttctctatccagattgcccctttattctttgctgcgtcactctggat

SEQ ID NO: 230936 - DNA, 38 bp, Artificial Sequence
  Synthetic oligonucleotide
  source (1)..(38): /organism="Artificial Sequence" /note="Description of Artificial Sequence: Synthetic oligonucleotide" /mol_type="unassigned DNA"
tgcaagctgctaatcagcgatgctctttggagtttttt

SEQ ID NO: 230937 - DNA, 37 bp, Artificial Sequence
  Synthetic oligonucleotide
  source (1)..(37): /organism="Artificial Sequence" /note="Description of Artificial Sequence: Synthetic oligonucleotide" /mol_type="unassigned DNA"
tttcaaggcactcgtgttcccgacatgagtgtttttt

SEQ ID NO: 230938 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtgtggttgggggtggtggaggtggggtttgtggtggga

SEQ ID NO: 230939 - DNA, 41 bp, Artificial Sequence
  Synthetic oligonucleotide
  source (1)..(41): /organism="Artificial Sequence" /note="Description of Artificial Sequence: Synthetic oligonucleotide" /mol_type="unassigned DNA"
ggtgtgggttgggggtggtggaggtggggtttgtggtggga

SEQ ID NO: 230940 - DNA, 39 bp, Artificial Sequence
  Synthetic oligonucleotide
  source (1)..(39): /organism="Artificial Sequence" /note="Description of Artificial Sequence: Synthetic oligonucleotide" /mol_type="unassigned DNA"
ggtgtggttgggggtggtggaggtgggtttgtggtggga

SEQ ID NO: 230941 - DNA, 42 bp, Artificial Sequence
  Synthetic oligonucleotide
  source (1)..(42): /organism="Artificial Sequence" /note="Description of Artificial Sequence: Synthetic oligonucleotide" /mol_type="unassigned DNA"
ggtgtgggttgggggtggtggaggtggggtttgtggtgggag

SEQ ID NO: 230942 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtgtgggttgggggtggtggaggtggggtttgtggtggg

SEQ ID NO: 230943 - DNA, 30 bp, Artificial Sequence
  Synthetic oligonucleotide
  source (1)..(30): /organism="Artificial Sequence" /note="Description of Artificial Sequence: Synthetic oligonucleotide" /mol_type="unassigned DNA"
ggtgtgggttgggggtggtggaggtggggt

SEQ ID NO: 230944 - DNA, 24 bp, Artificial Sequence
  Synthetic oligonucleotide
  source (1)..(24): /organism="Artificial Sequence" /note="Description of Artificial Sequence: Synthetic oligonucleotide" /mol_type="unassigned DNA"
ggtgtgggttgggggtggtggagg

SEQ ID NO: 230945 - DNA, 23 bp, Artificial Sequence
  Synthetic oligonucleotide
  source (1)..(23): /organism="Artificial Sequence" /note="Description of Artificial Sequence: Synthetic oligonucleotide" /mol_type="unassigned DNA"
ggtgtgggttgggggtggtggag

SEQ ID NO: 230946 - DNA, 41 bp, Artificial Sequence
  Synthetic oligonucleotide
  source (1)..(41): /organism="Artificial Sequence" /note="Description of Artificial Sequence: Synthetic oligonucleotide" /mol_type="unassigned DNA"
ggtgtggttgggggtggtggaggtggggtttgtggtgggag

SEQ ID NO: 230947 - DNA, 24 bp, Artificial Sequence
  Synthetic oligonucleotide
  source (1)..(24): /organism="Artificial Sequence" /note="Description of Artificial Sequence: Synthetic oligonucleotide" /mol_type="unassigned DNA"
gtggaggtggggtttgtggtggga

SEQ ID NO: 230948 - DNA, 28 bp, Artificial Sequence
  Synthetic oligonucleotide
  source (1)..(28): /organism="Artificial Sequence" /note="Description of Artificial Sequence: Synthetic oligonucleotide" /mol_type="unassigned DNA"
gggtggtggaggtgggtttgtggtggga

SEQ ID NO: 230949 - DNA, 41 bp, Artificial Sequence
  Synthetic oligonucleotide
  source (1)..(41): /organism="Artificial Sequence" /note="Description of Artificial Sequence: Synthetic oligonucleotide" /mol_type="unassigned DNA"
ggtggtggttgggggtggtggaggtggggtttgtggtggga

SEQ ID NO: 230950 - DNA, 23 bp, Artificial Sequence
  Synthetic oligonucleotide
  source (1)..(23): /organism="Artificial Sequence" /note="Description of Artificial Sequence: Synthetic oligonucleotide" /mol_type="unassigned DNA"
gtggaggtgggtttgtggtggga

SEQ ID NO: 230951 - DNA, 29 bp, Artificial Sequence
  Synthetic oligonucleotide
  source (1)..(29): /organism="Artificial Sequence" /note="Description of Artificial Sequence: Synthetic oligonucleotide" /mol_type="unassigned DNA"
gggtggtggaggtggggtttgtggtggga

SEQ ID NO: 230952 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgttgaaggttgggcggttggggtgtgtgggattggtggg

SEQ ID NO: 230953 - DNA, 29 bp, Artificial Sequence
  Synthetic oligonucleotide
  source (1)..(29): /organism="Artificial Sequence" /note="Description of Artificial Sequence: Synthetic oligonucleotide" /mol_type="unassigned DNA"
ggtgtggttgggggtggtggaggtggggt

SEQ ID NO: 230954 - DNA, 18 bp, Artificial Sequence
  Synthetic oligonucleotide
  source (1)..(18): /organism="Artificial Sequence" /note="Description of Artificial Sequence: Synthetic oligonucleotide" /mol_type="unassigned DNA"
gtggggtttgtggtggga

SEQ ID NO: 230955 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcctagaggtcgggtggttggggttgtgggatggggggt

SEQ ID NO: 230956 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggtgttgtcctgttggccttttgttgtcgcaccctcgca

SEQ ID NO: 230957 - DNA, 39 bp, Artificial Sequence
  Synthetic oligonucleotide
  source (1)..(39): /organism="Artificial Sequence" /note="Description of Artificial Sequence: Synthetic oligonucleotide" /mol_type="unassigned DNA"
ggtgtggttgggggtggtggaggtggggtttgtggtggg

SEQ ID NO: 230958 - DNA, 25 bp, Artificial Sequence
  Synthetic oligonucleotide
  source (1)..(25): /organism="Artificial Sequence" /note="Description of Artificial Sequence: Synthetic oligonucleotide" /mol_type="unassigned DNA"
ggtggaggtggggtttgtggtggga

SEQ ID NO: 230959 - DNA, 23 bp, Artificial Sequence
  Synthetic oligonucleotide
  source (1)..(23): /organism="Artificial Sequence" /note="Description of Artificial Sequence: Synthetic oligonucleotide" /mol_type="unassigned DNA"
ggtgtggttgggggtggtggagg

SEQ ID NO: 230960 - DNA, 38 bp, Artificial Sequence
  Synthetic oligonucleotide
  source (1)..(38): /organism="Artificial Sequence" /note="Description of Artificial Sequence: Synthetic oligonucleotide" /mol_type="unassigned DNA"
ggtgtggttggggtggtggaggtgggtttgtggtggga

SEQ ID NO: 230961 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcctggcacgtcgcgtttgtgttcgttggtcggtcagg

SEQ ID NO: 230962 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgagggtgggtggtgggttgatgttggttgatgggggtgg

SEQ ID NO: 230963 - DNA, 24 bp, Artificial Sequence
  Synthetic oligonucleotide
  source (1)..(24): /organism="Artificial Sequence" /note="Description of Artificial Sequence: Synthetic oligonucleotide" /mol_type="unassigned DNA"
ggtggaggtgggtttgtggtggga

SEQ ID NO: 230964 - DNA, 23 bp, Artificial Sequence
  Synthetic oligonucleotide
  source (1)..(23): /organism="Artificial Sequence" /note="Description of Artificial Sequence: Synthetic oligonucleotide" /mol_type="unassigned DNA"
ggtgtgggttggggtggtggagg

SEQ ID NO: 230965 - DNA, 18 bp, Artificial Sequence
  Synthetic oligonucleotide
  source (1)..(18): /organism="Artificial Sequence" /note="Description of Artificial Sequence: Synthetic oligonucleotide" /mol_type="unassigned DNA"
ggtgtgggttgggggtgg

SEQ ID NO: 230966 - DNA, 22 bp, Artificial Sequence
  Synthetic oligonucleotide
  source (1)..(22): /organism="Artificial Sequence" /note="Description of Artificial Sequence: Synthetic oligonucleotide" /mol_type="unassigned DNA"
ggtgttgtgggggtgtttgtcg

SEQ ID NO: 230967 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggtcttgctgggtggtcgtgcggtgttcgtggtggtggt

SEQ ID NO: 230968 - DNA, 39 bp, Artificial Sequence
  Synthetic oligonucleotide
  source (1)..(39): /organism="Artificial Sequence" /note="Description of Artificial Sequence: Synthetic oligonucleotide" /mol_type="unassigned DNA"
ggtgtggttggggtggtggaggtggggtttgtggtggga

SEQ ID NO: 230969 - DNA, 38 bp, Artificial Sequence
  Synthetic oligonucleotide
  source (1)..(38): /organism="Artificial Sequence" /note="Description of Artificial Sequence: Synthetic oligonucleotide" /mol_type="unassigned DNA"
ggtgtggttgggggtggtggaggtgggttgtggtggga

SEQ ID NO: 230970 - DNA, 36 bp, Artificial Sequence
  Synthetic oligonucleotide
  source (1)..(36): /organism="Artificial Sequence" /note="Description of Artificial Sequence: Synthetic oligonucleotide" /mol_type="unassigned DNA"
tggttgggggtggtggaggtggggtttgtggtggga

SEQ ID NO: 230971 - DNA, 20 bp, Artificial Sequence
  Synthetic oligonucleotide
  source (1)..(20): /organism="Artificial Sequence" /note="Description of Artificial Sequence: Synthetic oligonucleotide" /mol_type="unassigned DNA"
ggtgtgggttgggggtggtg

SEQ ID NO: 230972 - DNA, 35 bp, Artificial Sequence
  Synthetic oligonucleotide
  source (1)..(35): /organism="Artificial Sequence" /note="Description of Artificial Sequence: Synthetic oligonucleotide" /mol_type="unassigned DNA"
ggttgggggtggtggaggtggggtttgtggtggga

SEQ ID NO: 230973 - DNA, 22 bp, Artificial Sequence
  Synthetic oligonucleotide
  source (1)..(22): /organism="Artificial Sequence" /note="Description of Artificial Sequence: Synthetic oligonucleotide" /mol_type="unassigned DNA"
ggtgtgggttggggtggtggag

SEQ ID NO: 230974 - DNA, 33 bp, Artificial Sequence
  Synthetic oligonucleotide
  source (1)..(33): /organism="Artificial Sequence" /note="Description of Artificial Sequence: Synthetic oligonucleotide" /mol_type="unassigned DNA"
ggtgtgggttgggggtggtggaggtggggtttg

SEQ ID NO: 230975 - DNA, 37 bp, Artificial Sequence
  Synthetic oligonucleotide
  source (1)..(37): /organism="Artificial Sequence" /note="Description of Artificial Sequence: Synthetic oligonucleotide" /mol_type="unassigned DNA"
ggtgtggttggggtggtggaggtgggttgtggtggga

SEQ ID NO: 230976 - DNA, 14 bp, Artificial Sequence
  Synthetic oligonucleotide
  source (1)..(14): /organism="Artificial Sequence" /note="Description of Artificial Sequence: Synthetic oligonucleotide" /mol_type="unassigned DNA"
ggtttgtggtggga

SEQ ID NO: 230977 - DNA, 36 bp, Artificial Sequence
  Synthetic oligonucleotide
  source (1)..(36): /organism="Artificial Sequence" /note="Description of Artificial Sequence: Synthetic oligonucleotide" /mol_type="unassigned DNA"
ggtgtgggttgggggtggtggaggtggggtttgtgg

SEQ ID NO: 230978 - DNA, 22 bp, Artificial Sequence
  Synthetic oligonucleotide
  source (1)..(22): /organism="Artificial Sequence" /note="Description of Artificial Sequence: Synthetic oligonucleotide" /mol_type="unassigned DNA"
gtggaggtgggttgtggtggga

SEQ ID NO: 230979 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcacgtgcttcatttttgtgttccctcctcctgctgcgca

SEQ ID NO: 230980 - DNA, 28 bp, Artificial Sequence
  Synthetic oligonucleotide
  source (1)..(28): /organism="Artificial Sequence" /note="Description of Artificial Sequence: Synthetic oligonucleotide" /mol_type="unassigned DNA"
ggtgtgggttgggggtggtggaggtggg

SEQ ID NO: 230981 - DNA, 26 bp, Artificial Sequence
  Synthetic oligonucleotide
  source (1)..(26): /organism="Artificial Sequence" /note="Description of Artificial Sequence: Synthetic oligonucleotide" /mol_type="unassigned DNA"
gtggtggaggtgggtttgtggtggga

SEQ ID NO: 230982 - DNA, 27 bp, Artificial Sequence
  Synthetic oligonucleotide
  source (1)..(27): /organism="Artificial Sequence" /note="Description of Artificial Sequence: Synthetic oligonucleotide" /mol_type="unassigned DNA"
gtggtggaggtggggtttgtggtggga

SEQ ID NO: 230983 - DNA, 23 bp, Artificial Sequence
  Synthetic oligonucleotide
  source (1)..(23): /organism="Artificial Sequence" /note="Description of Artificial Sequence: Synthetic oligonucleotide" /mol_type="unassigned DNA"
ggtgttggtgggggtgtttgtcg

SEQ ID NO: 230984 - DNA, 27 bp, Artificial Sequence
  Synthetic oligonucleotide
  source (1)..(27): /organism="Artificial Sequence" /note="Description of Artificial Sequence: Synthetic oligonucleotide" /mol_type="unassigned DNA"
gggtggtggaggtgggttgtggtggga

SEQ ID NO: 230985 - DNA, 39 bp, Artificial Sequence
  Synthetic oligonucleotide
  source (1)..(39): /organism="Artificial Sequence" /note="Description of Artificial Sequence: Synthetic oligonucleotide" /mol_type="unassigned DNA"
gtgtggttgggggtggtggaggtggggtttgtggtggga

SEQ ID NO: 230986 - DNA, 8 bp, Artificial Sequence
  Synthetic oligonucleotide
  source (1)..(8): /organism="Artificial Sequence" /note="Description of Artificial Sequence: Synthetic oligonucleotide" /mol_type="unassigned DNA"
tggtggga

SEQ ID NO: 230987 - DNA, 41 bp, Artificial Sequence
  Synthetic oligonucleotide
  source (1)..(41): /organism="Artificial Sequence" /note="Description of Artificial Sequence: Synthetic oligonucleotide" /mol_type="unassigned DNA"
aggtgtggttgggggtggtggaggtggggtttgtggtggga

SEQ ID NO: 230988 - DNA, 15 bp, Artificial Sequence
  Synthetic oligonucleotide
  source (1)..(15): /organism="Artificial Sequence" /note="Description of Artificial Sequence: Synthetic oligonucleotide" /mol_type="unassigned DNA"
gtgggttgtggtgga

SEQ ID NO: 230989 - DNA, 17 bp, Artificial Sequence
  Synthetic oligonucleotide
  source (1)..(17): /organism="Artificial Sequence" /note="Description of Artificial Sequence: Synthetic oligonucleotide" /mol_type="unassigned DNA"
gtgggtttgtggtggga

SEQ ID NO: 230990 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acacgaacgcgcattgttttcgcatccttcctcctttcca

SEQ ID NO: 230991 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgggcgggggtggttgtatcttctatgggagggggttggc

SEQ ID NO: 230992 - DNA, 31 bp, Artificial Sequence
  Synthetic oligonucleotide
  source (1)..(31): /organism="Artificial Sequence" /note="Description of Artificial Sequence: Synthetic oligonucleotide" /mol_type="unassigned DNA"
ggtgtgggttgggggtggtggaggtggggtt

SEQ ID NO: 230993 - DNA, 39 bp, Artificial Sequence
  Synthetic oligonucleotide
  source (1)..(39): /organism="Artificial Sequence" /note="Description of Artificial Sequence: Synthetic oligonucleotide" /mol_type="unassigned DNA"
ggtgtggttgggggtggtggaggtggggttgtggtggga

SEQ ID NO: 230994 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgtgatgtgggtgggtggtgggcttggtgtgtgggggtgg

SEQ ID NO: 230995 - DNA, 41 bp, Artificial Sequence
  Synthetic oligonucleotide
  source (1)..(41): /organism="Artificial Sequence" /note="Description of Artificial Sequence: Synthetic oligonucleotide" /mol_type="unassigned DNA"
ggtgtgggttgggggtggtggaggtggggttgtggtgggag

SEQ ID NO: 230996 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtgtgggttggggtggtggaggtggggtttgtggtggga

SEQ ID NO: 230997 - DNA, 22 bp, Artificial Sequence
  Synthetic oligonucleotide
  source (1)..(22): /organism="Artificial Sequence" /note="Description of Artificial Sequence: Synthetic oligonucleotide" /mol_type="unassigned DNA"
ggtgtggttgggggtggtggag

SEQ ID NO: 230998 - DNA, 29 bp, Artificial Sequence
  Synthetic oligonucleotide
  source (1)..(29): /organism="Artificial Sequence" /note="Description of Artificial Sequence: Synthetic oligonucleotide" /mol_type="unassigned DNA"
ggtgtgggttggggtggtggaggtggggt

SEQ ID NO: 230999 - DNA, 27 bp, Artificial Sequence
  Synthetic oligonucleotide
  source (1)..(27): /organism="Artificial Sequence" /note="Description of Artificial Sequence: Synthetic oligonucleotide" /mol_type="unassigned DNA"
ggtgtggttgggggtggtggaggtggg

SEQ ID NO: 231000 - DNA, 35 bp, Artificial Sequence
  Synthetic oligonucleotide
  source (1)..(35): /organism="Artificial Sequence" /note="Description of Artificial Sequence: Synthetic oligonucleotide" /mol_type="unassigned DNA"
ggtgtggttgggggtggtggaggtggggtttgtgg

SEQ ID NO: 231001 - DNA, 10 bp, Artificial Sequence
  Synthetic oligonucleotide
  source (1)..(10): /organism="Artificial Sequence" /note="Description of Artificial Sequence: Synthetic oligonucleotide" /mol_type="unassigned DNA"
tgtggtggga

SEQ ID NO: 231002 - DNA, 43 bp, Artificial Sequence
  Synthetic oligonucleotide
  source (1)..(43): /organism="Artificial Sequence" /note="Description of Artificial Sequence: Synthetic oligonucleotide" /mol_type="unassigned DNA"
ggtgtgggttgggggtggtggaggtggggtttggtggtgggag

SEQ ID NO: 231003 - DNA, 36 bp, Artificial Sequence
  Synthetic oligonucleotide
  source (1)..(36): /organism="Artificial Sequence" /note="Description of Artificial Sequence: Synthetic oligonucleotide" /mol_type="unassigned DNA"
ggtgtggttggggtggtggaggtgggttgtggtgga

SEQ ID NO: 231004 - DNA, 30 bp, Artificial Sequence
  Synthetic oligonucleotide
  source (1)..(30): /organism="Artificial Sequence" /note="Description of Artificial Sequence: Synthetic oligonucleotide" /mol_type="unassigned DNA"
ggggtggtggaggtggggtttgtggtggga

SEQ ID NO: 231005 - DNA, 14 bp, Artificial Sequence
  Synthetic oligonucleotide
  source (1)..(14): /organism="Artificial Sequence" /note="Description of Artificial Sequence: Synthetic oligonucleotide" /mol_type="unassigned DNA"
ggtgtgggttgggg

SEQ ID NO: 231006 - DNA, 19 bp, Artificial Sequence
  Synthetic oligonucleotide
  source (1)..(19): /organism="Artificial Sequence" /note="Description of Artificial Sequence: Synthetic oligonucleotide" /mol_type="unassigned DNA"
ggtgtggttgggggtggtg

SEQ ID NO: 231007 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtcttcgttcgtcgtcgtgacctcgtatctttggctt

SEQ ID NO: 231008 - DNA, 39 bp, Artificial Sequence
  Synthetic oligonucleotide
  source (1)..(39): /organism="Artificial Sequence" /note="Description of Artificial Sequence: Synthetic oligonucleotide" /mol_type="unassigned DNA"
ggtgtggttgggggtggtggaggtggggtttgtggtgga

SEQ ID NO: 231009 - DNA, 46 bp, Artificial Sequence
  Synthetic oligonucleotide
  source (1)..(46): /organism="Artificial Sequence" /note="Description of Artificial Sequence: Synthetic oligonucleotide" /mol_type="unassigned DNA"
  site (19)..(28): n = a, g, c, t/u, unknown or other
  misc_feature (19)..(28): n is a, c, g, or t
actaagccaccgtgtccannnnnnnnnntgctgcgtcactctggat

SEQ ID NO: 231010 - DNA, 56 bp, Artificial Sequence
  Synthetic oligonucleotide
  source (1)..(56): /organism="Artificial Sequence" /note="Description of Artificial Sequence: Synthetic oligonucleotide" /mol_type="unassigned DNA"
  site (19)..(38): n = a, g, c, t/u, unknown or other
  misc_feature (19)..(38): n is a, c, g, or t
actaagccaccgtgtccannnnnnnnnnnnnnnnnnnntgctgcgtcactctggat

SEQ ID NO: 231011 - DNA, 61 bp, Artificial Sequence
  Synthetic oligonucleotide
  source (1)..(61): /organism="Artificial Sequence" /note="Description of Artificial Sequence: Synthetic oligonucleotide" /mol_type="unassigned DNA"
  site (19)..(43): n = a, g, c, t/u, unknown or other
  misc_feature (19)..(43): n is a, c, g, or t
actaagccaccgtgtccannnnnnnnnnnnnnnnnnnnnnnnntgctgcgtcactctggat

SEQ ID NO: 231012 - DNA, 66 bp, Artificial Sequence
  Synthetic oligonucleotide
  source (1)..(66): /organism="Artificial Sequence" /note="Description of Artificial Sequence: Synthetic oligonucleotide" /mol_type="unassigned DNA"
  site (19)..(48): n = a, g, c, t/u, unknown or other
  misc_feature (19)..(48): n is a, c, g, or t
actaagccaccgtgtccannnnnnnnnnnnnnnnnnnnnnnnnnnnnntgctgcgtcactctggat

SEQ ID NO: 231013 - DNA, 71 bp, Artificial Sequence
  Synthetic oligonucleotide
  source (1)..(71): /organism="Artificial Sequence" /note="Description of Artificial Sequence: Synthetic oligonucleotide" /mol_type="unassigned DNA"
  site (19)..(53): n = a, g, c, t/u, unknown or other
  misc_feature (19)..(53): n is a, c, g, or t
actaagccaccgtgtccannnnnnnnnnnnnnnnnnnnnnnnnnnnnnnnnnntgctgcgtcactctggat

SEQ ID NO: 231014 - DNA, 76 bp, Artificial Sequence
  Synthetic oligonucleotide
  source (1)..(76): /organism="Artificial Sequence" /note="Description of Artificial Sequence: Synthetic oligonucleotide" /mol_type="unassigned DNA"
  site (19)..(58): n = a, g, c, t/u, unknown or other
  misc_feature (19)..(58): n is a, c, g, or t
actaagccaccgtgtccannnnnnnnnnnnnnnnnnnnnnnnnnnnnnnnnnnnnnnntgctgcgtcactctggat

SEQ ID NO: 231015 - DNA, 17 bp, Artificial Sequence
  Synthetic oligonucleotide
  source (1)..(17): /organism="Artificial Sequence" /note="Description of Artificial Sequence: Synthetic oligonucleotide" /mol_type="unassigned DNA"
gtaaaacgacggccagt

SEQ ID NO: 231016 - DNA, 17 bp, Artificial Sequence
  Synthetic oligonucleotide
  source (1)..(17): /organism="Artificial Sequence" /note="Description of Artificial Sequence: Synthetic oligonucleotide" /mol_type="unassigned DNA"
caggaaacagctatgac

SEQ ID NO: 231017 - RNA, 80 nt, Artificial Sequence
  Synthetic oligonucleotide
  source (1)..(80): /organism="Artificial Sequence" /note="SUL1_RNA_library; Description of Artificial Sequence: Synthetic oligonucleotide; n=aucg" /mol_type="unassigned RNA"
  site (16)..(55): n = a, g, c, t/u, unknown or other
  misc_feature (16)..(55): n is a, c, g, or u
gggaggacgaugcggnnnnnnnnnnnnnnnnnnnnnnnnnnnnnnnnnnnnnnnncagacgacucgcugaggauccgaga

SEQ ID NO: 231018 - RNA, 80 nt, Artificial Sequence
  Synthetic oligonucleotide
  source (1)..(80): /organism="Artificial Sequence" /note="BRCA_APT1_RNA; Description of Artificial Sequence: Synthetic oligonucleotide" /mol_type="unassigned RNA"
gggaggacgaugcggcgcgucuuccccgcauugccgcaauugccauacauuaauacagacgacucgcugaggauccgaga

SEQ ID NO: 231019 - DNA, 80 bp, Artificial Sequence
  Synthetic oligonucleotide
  source (1)..(80): /organism="Artificial Sequence" /note="BRCA_APT1_DNA; Description of Artificial Sequence: Synthetic oligonucleotide" /mol_type="unassigned DNA"
gggaggacgatgcggcgcgtcttccccgcattgccgcaattgccatacattaatacagacgactcgctgaggatccgaga

SEQ ID NO: 231020 - RNA, 80 nt, Artificial Sequence
  Synthetic oligonucleotide
  source (1)..(80): /organism="Artificial Sequence" /note="BRCA_APT2_RNA; Description of Artificial Sequence: Synthetic oligonucleotide" /mol_type="unassigned RNA"
gggaggacgaugcggguccggaacgccucgauccucgcauaauaugauacgucugcagacgacucgcugaggauccgaga

SEQ ID NO: 231021 - DNA, 80 bp, Artificial Sequence
  Synthetic oligonucleotide
  source (1)..(80): /organism="Artificial Sequence" /note="BRCA_APT2_DNA; Description of Artificial Sequence: Synthetic oligonucleotide" /mol_type="unassigned DNA"
gggaggacgatgcgggtccggaacgcctcgatcctcgcataatatgatacgtctgcagacgactcgctgaggatccgaga

SEQ ID NO: 231022 - RNA, 80 nt, Artificial Sequence
  Synthetic oligonucleotide
  source (1)..(80): /organism="Artificial Sequence" /note="BRCA_APT3_RNA; Description of Artificial Sequence: Synthetic oligonucleotide" /mol_type="unassigned RNA"
gggaggacgaugcggguccaugguacgccucgauuccgcccauacaugcauguaacagacgacucgcugaggauccgaga

SEQ ID NO: 231023 - DNA, 80 bp, Artificial Sequence
  Synthetic oligonucleotide
  source (1)..(80): /organism="Artificial Sequence" /note="BRCA_APT3_DNA; Description of Artificial Sequence: Synthetic oligonucleotide" /mol_type="unassigned DNA"
gggaggacgatgcgggtccatggtacgcctcgattccgcccatacatgcatgtaacagacgactcgctgaggatccgaga

SEQ ID NO: 231024 - RNA, 80 nt, Artificial Sequence
  Synthetic oligonucleotide
  source (1)..(80): /organism="Artificial Sequence" /note="BRCA_APT4_RNA; Description of Artificial Sequence: Synthetic oligonucleotide" /mol_type="unassigned RNA"
gggaggacgaugcggcacuauccguuuguccguccucuugugguauugcgcaugccagacgacucgcugaggauccgaga

SEQ ID NO: 231025 - DNA, 80 bp, Artificial Sequence
  Synthetic oligonucleotide
  source (1)..(80): /organism="Artificial Sequence" /note="BRCA_APT4_DNA; Description of Artificial Sequence: Synthetic oligonucleotide" /mol_type="unassigned DNA"
gggaggacgatgcggcactatccgtttgtccgtcctcttgtggtattgcgcatgccagacgactcgctgaggatccgaga

SEQ ID NO: 231026 - RNA, 80 nt, Artificial Sequence
  Synthetic oligonucleotide
  source (1)..(80): /organism="Artificial Sequence" /note="BRCA_APT5_RNA; Description of Artificial Sequence: Synthetic oligonucleotide" /mol_type="unassigned RNA"
gggaggacgaugcggucuuccaucuggucgcgauacagaauacgauuaacauaaacagacgacucgcugaggauccgaga

SEQ ID NO: 231027 - DNA, 80 bp, Artificial Sequence
  Synthetic oligonucleotide
  source (1)..(80): /organism="Artificial Sequence" /note="BRCA_APT5_DNA; Description of Artificial Sequence: Synthetic oligonucleotide" /mol_type="unassigned DNA"
gggaggacgatgcggtcttccatctggtcgcgatacagaatacgattaacataaacagacgactcgctgaggatccgaga

SEQ ID NO: 231028 - RNA, 80 nt, Artificial Sequence
  Synthetic oligonucleotide
  source (1)..(80): /organism="Artificial Sequence" /note="BRCA_APT6_RNA; Description of Artificial Sequence: Synthetic oligonucleotide" /mol_type="unassigned RNA"
gggaggacgaugcgggaucacgcugcccuuuguuuaaggccuuuauacaaacgcacagacgacucgcugaggauccgaga

SEQ ID NO: 231029 - DNA, 80 bp, Artificial Sequence
  Synthetic oligonucleotide
  source (1)..(80): /organism="Artificial Sequence" /note="BRCA_APT6_DNA; Description of Artificial Sequence: Synthetic oligonucleotide" /mol_type="unassigned DNA"
gggaggacgatgcgggatcacgctgccctttgtttaaggcctttatacaaacgcacagacgactcgctgaggatccgaga

SEQ ID NO: 231030 - RNA, 80 nt, Artificial Sequence
  Synthetic oligonucleotide
  source (1)..(80): /organism="Artificial Sequence" /note="BRCA_APT7_RNA; Description of Artificial Sequence: Synthetic oligonucleotide" /mol_type="unassigned RNA"
gggaggacgaugcgguauucgccagucacaucaacuaugaugacgcuugacuggacagacgacucgcugaggauccgaga

SEQ ID NO: 231031 - DNA, 80 bp, Artificial Sequence
  Synthetic oligonucleotide
  source (1)..(80): /organism="Artificial Sequence" /note="BRCA_APT7_DNA; Description of Artificial Sequence: Synthetic oligonucleotide" /mol_type="unassigned DNA"
gggaggacgatgcggtattcgccagtcacatcaactatgatgacgcttgactggacagacgactcgctgaggatccgaga

SEQ ID NO: 231032 - RNA, 80 nt, Artificial Sequence
  Synthetic oligonucleotide
  source (1)..(80): /organism="Artificial Sequence" /note="BCE8; Description of Artificial Sequence: Synthetic oligonucleotide" /mol_type="unassigned RNA"
gggaggacgaugcgguaccgccucaucaucggacacgacguguaucaguuggcugcagacgacucgcugaggauccgaga

SEQ ID NO: 231033 - RNA, 80 nt, Artificial Sequence
  Synthetic oligonucleotide
  source (1)..(80): /organism="Artificial Sequence" /note="BCE9; Description of Artificial Sequence: Synthetic oligonucleotide" /mol_type="unassigned RNA"
gggaggacgaugcggguucucgccucuguccucaugguucgaaccgguaugcaugcagacgacucgcugaggauccgaga

SEQ ID NO: 231034 - RNA, 80 nt, Artificial Sequence
  Synthetic oligonucleotide
  source (1)..(80): /organism="Artificial Sequence" /note="BCE10; Description of Artificial Sequence: Synthetic oligonucleotide" /mol_type="unassigned RNA"
gggaggacgaugcgggcgguuucuucuccugacuacaugagauuaauaaacgcgccagacgacucgcugaggauccgaga

SEQ ID NO: 231035 - RNA, 80 nt, Artificial Sequence
  Synthetic oligonucleotide
  source (1)..(80): /organism="Artificial Sequence" /note="BCE11; Description of Artificial Sequence: Synthetic oligonucleotide" /mol_type="unassigned RNA"
gggaggacgaugcggccgccucgaacacugacgucguggaaccuucgauugcuagcagacgacucgcugaggauccgaga

SEQ ID NO: 231036 - RNA, 80 nt, Artificial Sequence
  Synthetic oligonucleotide
  source (1)..(80): /organism="Artificial Sequence" /note="BCE12; Description of Artificial Sequence: Synthetic oligonucleotide" /mol_type="unassigned RNA"
gggaggacgaugcggaaucacaguaauucugccccucugaugaaaccgguuacuucagacgacucgcugaggauccgaga

SEQ ID NO: 231037 - RNA, 80 nt, Artificial Sequence
  Synthetic oligonucleotide
  source (1)..(80): /organism="Artificial Sequence" /note="BCE13; Description of Artificial Sequence: Synthetic oligonucleotide" /mol_type="unassigned RNA"
gggaggacgaugcggcuuagugauuucgccgccccucuguuuaguggccauuggacagacgacucgcugaggauccgaga

SEQ ID NO: 231038 - RNA, 80 nt, Artificial Sequence
  Synthetic oligonucleotide
  source (1)..(80): /organism="Artificial Sequence" /note="BCE14; Description of Artificial Sequence: Synthetic oligonucleotide" /mol_type="unassigned RNA"
gggaggacgaugcggacacuauuccgguaagucaucguuuaaccguuuguugcaacagacgacucgcugaggauccgaga

SEQ ID NO: 231039 - RNA, 80 nt, Artificial Sequence
  Synthetic oligonucleotide
  source (1)..(80): /organism="Artificial Sequence" /note="BCE15; Description of Artificial Sequence: Synthetic oligonucleotide" /mol_type="unassigned RNA"
gggaggacgaugcggugcgcaacgccuugauucacuccuacagugugucuauagacagacgacucgcugaggauccgaga

SEQ ID NO: 231040 - RNA, 80 nt, Artificial Sequence
  Synthetic oligonucleotide
  source (1)..(80): /organism="Artificial Sequence" /note="BCE16; Description of Artificial Sequence: Synthetic oligonucleotide" /mol_type="unassigned RNA"
gggaggacgaugcggaauguuaagcuuacauacgccugggucacucuuuguucugcagacgacucgcugaggauccgaga

SEQ ID NO: 231041 - RNA, 80 nt, Artificial Sequence
  Synthetic oligonucleotide
  source (1)..(80): /organism="Artificial Sequence" /note="BCE17; Description of Artificial Sequence: Synthetic oligonucleotide" /mol_type="unassigned RNA"
gggaggacgaugcggguaaauauucacguugaaucgccuugcuccucuuagucugcagacgacucgcugaggauccgaga

SEQ ID NO: 231042 - RNA, 80 nt, Artificial Sequence
  Synthetic oligonucleotide
  source (1)..(80): /organism="Artificial Sequence" /note="BCE18; Description of Artificial Sequence: Synthetic oligonucleotide" /mol_type="unassigned RNA"
gggaggacgaugcggccgccucggaucguucccaauggugguaccccuauuaaugcagacgacucgcugaggauccgaga

SEQ ID NO: 231043 - RNA, 80 nt, Artificial Sequence
  Synthetic oligonucleotide
  source (1)..(80): /organism="Artificial Sequence" /note="BCE19; Description of Artificial Sequence: Synthetic oligonucleotide" /mol_type="unassigned RNA"
gggaggacgaugcgguguagaucguucuuauccgccucggucuuccccagguuaacagacgacucgcugaggauccgaga

SEQ ID NO: 231044 - RNA, 80 nt, Artificial Sequence
  Synthetic oligonucleotide
  source (1)..(80): /organism="Artificial Sequence" /note="BCE20; Description of Artificial Sequence: Synthetic oligonucleotide" /mol_type="unassigned RNA"
gggaggacgaugcggaucgucgggccccuuuuaugaaacuuacaugaaagcgcaccagacgacucgcugaggauccgaga

SEQ ID NO: 231045 - RNA, 80 nt, Artificial Sequence
  Synthetic oligonucleotide
  source (1)..(80): /organism="Artificial Sequence" /note="BCE21; Description of Artificial Sequence: Synthetic oligonucleotide" /mol_type="unassigned RNA"
gggaggacgaugcgguaagagugcacaguacugccucgauccuccauggcuuaagcagacgacucgcugaggauccgaga

SEQ ID NO: 231046 - RNA, 80 nt, Artificial Sequence
  Synthetic oligonucleotide
  source (1)..(80): /organism="Artificial Sequence" /note="BCE22; Description of Artificial Sequence: Synthetic oligonucleotide" /mol_type="unassigned RNA"
gggaggacgaugcgggaauuaguacugacggccgccuugauccuccguuagucugcagacgacucgcugaggauccgaga

SEQ ID NO: 231047 - RNA, 80 nt, Artificial Sequence
  Synthetic oligonucleotide
  source (1)..(80): /organism="Artificial Sequence" /note="BCE23; Description of Artificial Sequence: Synthetic oligonucleotide" /mol_type="unassigned RNA"
gggaggacgaugcgggcccgccuccgaagcccuccuaagugcacuuuaaaccgcgcagacgacucgcugaggauccgaga

SEQ ID NO: 231048 - RNA, 80 nt, Artificial Sequence
  Synthetic oligonucleotide
  source (1)..(80): /organism="Artificial Sequence" /note="BCE24; Description of Artificial Sequence: Synthetic oligonucleotide" /mol_type="unassigned RNA"
gggaggacgaugcggccgccugggaucacucucuacgcguauaaaugcucugucacagacgacucgcugaggauccgaga

SEQ ID NO: 231049 - RNA, 80 nt, Artificial Sequence
  Synthetic oligonucleotide
  source (1)..(80): /organism="Artificial Sequence" /note="BCE25; Description of Artificial Sequence: Synthetic oligonucleotide" /mol_type="unassigned RNA"
gggaggacgaugcggagucugacccuguuauggacuaccauaucagaaagguacucagacgacucgcugaggauccgaga

SEQ ID NO: 231050 - RNA, 80 nt, Artificial Sequence
  Synthetic oligonucleotide
  source (1)..(80): /organism="Artificial Sequence" /note="BCE26; Description of Artificial Sequence: Synthetic oligonucleotide" /mol_type="unassigned RNA"
gggaggacgaugcggggugauccucccccccgccucgaagauuugugcacauauccagacgacucgcugaggauccgaga

SEQ ID NO: 231051 - RNA, 80 nt, Artificial Sequence
  Synthetic oligonucleotide
  source (1)..(80): /organism="Artificial Sequence" /note="BCE27; Description of Artificial Sequence: Synthetic oligonucleotide" /mol_type="unassigned RNA"
gggaggacgaugcgggcuaccaucgucuagugagucacccuuaguucaucaaggccagacgacucgcugaggauccgaga

SEQ ID NO: 231052 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccattgtctg

SEQ ID NO: 231053 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatgcatgtaa

SEQ ID NO: 231054 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgatacgtctg

SEQ ID NO: 231055 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactatcacgatt

SEQ ID NO: 231056 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcatgc

SEQ ID NO: 231057 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttgactgga

SEQ ID NO: 231058 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatcagttggctg

SEQ ID NO: 231059 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatctcgagcgaa

SEQ ID NO: 231060 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgacgcttgactgga

SEQ ID NO: 231061 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtacccgaactgggtt

SEQ ID NO: 231062 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggcctttatacaaacgca

SEQ ID NO: 231063 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccacgctcataa

SEQ ID NO: 231064 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttgggcagttac

SEQ ID NO: 231065 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggttcgaaccggtatgcatg

SEQ ID NO: 231066 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgcgcatgc

SEQ ID NO: 231067 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagagtgctcatgagc

SEQ ID NO: 231068 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattaataaacgcgc

SEQ ID NO: 231069 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgtggaaccttcgattgctag

SEQ ID NO: 231070 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggaccacccgtgtta

SEQ ID NO: 231071 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattctgcccctctgatgaaaccggttactt

SEQ ID NO: 231072 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacttgggcagttac

SEQ ID NO: 231073 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcctcgatcctctataccgtctg

SEQ ID NO: 231074 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctggcgtactacttggacaggttccttc

SEQ ID NO: 231075 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgcccatacatgcatgtaa

SEQ ID NO: 231076 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagactactactgatcacgtcg

SEQ ID NO: 231077 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttagtgatttcgccgcccctctgtttagtggccattgga

SEQ ID NO: 231078 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgattaacataaa

SEQ ID NO: 231079 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcataatatgatacgtctg

SEQ ID NO: 231080 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgtttgttgcaa

SEQ ID NO: 231081 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgattcactcctacagtgtgtctataga

SEQ ID NO: 231082 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcgtctcgagcgaa

SEQ ID NO: 231083 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaacttggcagttac

SEQ ID NO: 231084 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacatcgcggggaactaatggtt

SEQ ID NO: 231085 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttggtgggggactacccccttgta

SEQ ID NO: 231086 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcactacgcgtatggaatc

SEQ ID NO: 231087 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcaacaagcggctaaggcc

SEQ ID NO: 231088 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgaacagtgtgccgttttcggtg

SEQ ID NO: 231089 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtgtctggttaaacaacga

SEQ ID NO: 231090 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacatacgcctgggtcactctttgttctg

SEQ ID NO: 231091 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttggctgga

SEQ ID NO: 231092 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttcggtggtgtcctctccattacca

SEQ ID NO: 231093 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggttcttcgataatatgcaaca

SEQ ID NO: 231094 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcctcaagctagctacctccattgtctg

SEQ ID NO: 231095 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggccttcaccgtcctcaatacggacgaatg

SEQ ID NO: 231096 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgatccgtactttcaggcgctatcctgatcacccga

SEQ ID NO: 231097 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgacatcgagagagctacgtcatcaagcgctaa

SEQ ID NO: 231098 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcgctggaccacccgcgtta

SEQ ID NO: 231099 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctggtaacttgggcagttac

SEQ ID NO: 231100 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccggggcccgcctcaagctagctacctccattgtctg

SEQ ID NO: 231101 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtggtattgcgcatgc

SEQ ID NO: 231102 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcagctagtcgtgctttgtccgctatgacattca

SEQ ID NO: 231103 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattcacgttgaatcgccttgctcctcttagtctg

SEQ ID NO: 231104 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgcttgatctcctgtcgactctgcggctgagactact

SEQ ID NO: 231105 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactacccccatcgagcgagtctactctcccatcaacggg

SEQ ID NO: 231106 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttcctcagcttccgcggtgcaggatttgcacgt

SEQ ID NO: 231107 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcggatcgttcccaatggtggtacccctattaatg

SEQ ID NO: 231108 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcgagcgatcgtcgtaatactgcttccaa

SEQ ID NO: 231109 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggtattgcgcatgc

SEQ ID NO: 231110 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtagatcgttcttatccgcctcggtcttccccaggttaa

SEQ ID NO: 231111 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgtcgggccccttttatgaaacttacatgaaagcgcac

SEQ ID NO: 231112 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttcctcagcctccgcggtgcaggatttgcacgt

SEQ ID NO: 231113 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggtccgcctcaagctagctacctccattgtctg

SEQ ID NO: 231114 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccactgtctg

SEQ ID NO: 231115 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taagagtgcacagtactgcctcgatcctccatggcttaag

SEQ ID NO: 231116 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagtgggttccatgctttaggcgcctcttattttgggtc

SEQ ID NO: 231117 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcctcgaaattccctatatatgcatatatcagtctaggc

SEQ ID NO: 231118 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctctattgtctg

SEQ ID NO: 231119 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcgagctagctacctccattgtctg

SEQ ID NO: 231120 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccatcgtctg

SEQ ID NO: 231121 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggagcgcctcgatcctcgcataatatgatacgtctg

SEQ ID NO: 231122 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaattagtactgacggccgccttgatcctccgttagtctg

SEQ ID NO: 231123 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggatcctcgcctccatactacgtggatttagattt

SEQ ID NO: 231124 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcgctatcacgatt

SEQ ID NO: 231125 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgcctccgaagccctcctaagtgcactttaaaccgcg

SEQ ID NO: 231126 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttcctcggatcttcaacatattgccgcctcgcatccgac

SEQ ID NO: 231127 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgagcgagcactttgtgcgatcacaca

SEQ ID NO: 231128 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggagcccgcctcaagctagctacctccattgtctg

SEQ ID NO: 231129 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccattgtcta

SEQ ID NO: 231130 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttagcacttctcggtaacttgggcagttac

SEQ ID NO: 231131 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctgggatcactctctacgcgtataaatgctctgtca

SEQ ID NO: 231132 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacagaggccctcgtgttggactaccaacttgtagaacgg

SEQ ID NO: 231133 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttcatcggtaacttgggcagttac

SEQ ID NO: 231134 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaccggggcccgcctcaagctagctacctccattgtctg

SEQ ID NO: 231135 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggctttaagcacttctcggtaacttgggcagttac

SEQ ID NO: 231136 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtctgaccctgttatggactaccatatcagaaaggtact

SEQ ID NO: 231137 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagcaacctccattgtctg

SEQ ID NO: 231138 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctactccggatgagccacctcgcattcctccgttcgtctg

SEQ ID NO: 231139 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggctaacgttcatcgagggagcaaaaggtctatagacta

SEQ ID NO: 231140 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatgcatgcatgtaa

SEQ ID NO: 231141 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatctcgagatcactaggcactatcctagcactgtatcaa

SEQ ID NO: 231142 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccattgcctg

SEQ ID NO: 231143 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccgttgtctg

SEQ ID NO: 231144 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggatcccactgttaacagttcctccctcaggtgtgtcaa

SEQ ID NO: 231145 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccattatctg

SEQ ID NO: 231146 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgtatcttccggtaattaccacgtacgtacatgtctg

SEQ ID NO: 231147 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgcgtacgccttggttttcctgggtacccccgccgtttg

SEQ ID NO: 231148 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgtaccccgggttgcaattgcctcgtaaccagaccgcat

SEQ ID NO: 231149 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccaagtccccaattcgtcgtccgtacgctattacggttt

SEQ ID NO: 231150 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttgggccagttac

SEQ ID NO: 231151 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccattgtccg

SEQ ID NO: 231152 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacccccattgtctg

SEQ ID NO: 231153 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccggaacgcctcgatcctcgcataatatgatacgtctg

SEQ ID NO: 231154 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccggaagtccctcctcgtcttgatgcactatcatctca

SEQ ID NO: 231155 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatggtccatgagcttctggcactatccagttgacgctca

SEQ ID NO: 231156 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtgatcctcccccccgcctcgaagatttgtgcacatatc

SEQ ID NO: 231157 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccatcgtctagtgagtcacccttagttcatcaaggc

SEQ ID NO: 231158 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgtcttccccgcattgccgcaattgccatacattaata

SEQ ID NO: 231159 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttcaggttcccctaacgcgttagccttccggaatg

SEQ ID NO: 231160 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taggcggttttaagcacttctcggtaacttgggcagttac

SEQ ID NO: 231161 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcagggcgtctttcgtgcactatcacgatt

SEQ ID NO: 231162 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccttgatcctcgctttcggtgcactgactcgctttctg

SEQ ID NO: 231163 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccttccagggcccaatgccgcattatcatcctatgttctg

SEQ ID NO: 231164 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagatctcggatctggcgtactacttggacaggttccttc

SEQ ID NO: 231165 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaggctagctacctccattgtctg

SEQ ID NO: 231166 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttatccctgatgatccgaattctcatcggctggcactatc

SEQ ID NO: 231167 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatggtacgtctg

SEQ ID NO: 231168 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgcctttcgtgcactatcacgatt

SEQ ID NO: 231169 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctgcctccattgtctg

SEQ ID NO: 231170 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgatcccgcccatacatgcatgtaa

SEQ ID NO: 231171 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcctatccggcaggacgtctttcgtgcactatcacgatt

SEQ ID NO: 231172 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttccccctaacgcgttagccttccggaatg

SEQ ID NO: 231173 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttaagcacttctcggtaacttgggcagttac

SEQ ID NO: 231174 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcgtaacttgggcagttac

SEQ ID NO: 231175 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggttaacttgggcagttac

SEQ ID NO: 231176 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatataatacgtctg

SEQ ID NO: 231177 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccacacatgcatgtaa

SEQ ID NO: 231178 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccctctatagtcgtcggcgtagcacgctattgcttagaag

SEQ ID NO: 231179 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcggccgactcgcctcgatgctccacgtaacgttacgaa

SEQ ID NO: 231180 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctcggatcatttgcctcgctcctcctaaagttggatgg

SEQ ID NO: 231181 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agattctagattaaccgcctcggtcagcccagattgtgca

SEQ ID NO: 231182 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttgtccgtcctcttgtggtattgcgcatgc

SEQ ID NO: 231183 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcacataatatgatacgtctg

SEQ ID NO: 231184 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccgtacatgcatgtaa

SEQ ID NO: 231185 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatgcatgtga

SEQ ID NO: 231186 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtccctgtgtcttgttgccacagacgttcagtgcccccg

SEQ ID NO: 231187 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcacgc

SEQ ID NO: 231188 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actgtaggcacctgctctatgtcgtggggagtaacaggtt

SEQ ID NO: 231189 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagccggggcccgcctcaagctagctacctccattgtctg

SEQ ID NO: 231190 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctatctccattgtctg

SEQ ID NO: 231191 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacttccattgtctg

SEQ ID NO: 231192 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgcgactacgctcttgaacaattctgatccctggattt

SEQ ID NO: 231193 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcatagtatgatacgtctg

SEQ ID NO: 231194 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgatgcgtctg

SEQ ID NO: 231195 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgcgtcgtgtacacgaagacctccggagattttg

SEQ ID NO: 231196 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggtttcccctaacgcgttagccttccggaatg

SEQ ID NO: 231197 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgacacgtctg

SEQ ID NO: 231198 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attctgttttttaagttggcgaggtcctctaacttttggg

SEQ ID NO: 231199 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agaccggggcccgcctcaagctagctacctccattgtctg

SEQ ID NO: 231200 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctccttcctccatgagcatgcttactcgggatactg

SEQ ID NO: 231201 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcgtcttcgctggaccacccgtgtta

SEQ ID NO: 231202 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtgcctgaccgccttgatccttcttctcggaaacgcgta

SEQ ID NO: 231203 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actaccttcgtccagcggtgcgctggggactttatccctc

SEQ ID NO: 231204 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctggctacctccattgtctg

SEQ ID NO: 231205 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttgactggg

SEQ ID NO: 231206 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggcacgcctcgattccgcccatacatgcatgtaa

SEQ ID NO: 231207 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgtttagccttccggaatg

SEQ ID NO: 231208 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttactttctcggatcactaattgccgcatcacgcactccc

SEQ ID NO: 231209 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccggcactggaggcgtccttggtggactaccaccttat

SEQ ID NO: 231210 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctcttgtggtattgcgcatgc

SEQ ID NO: 231211 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagccacctccattgtctg

SEQ ID NO: 231212 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgccccaagctagctacctccattgtctg

SEQ ID NO: 231213 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgaggcccgcctcaagctagctacctccattgtctg

SEQ ID NO: 231214 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatgtgatacgtctg

SEQ ID NO: 231215 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccttatccggcaggacgtctttcgtgcactatcacgatt

SEQ ID NO: 231216 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accctatcttgacgtctcttcggggactaccccgattctg

SEQ ID NO: 231217 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcgcgaacgccttagtcacccttctcggataacatgatt

SEQ ID NO: 231218 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcacaatatgatacgtctg

SEQ ID NO: 231219 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttatgttcgcctctctctcggttgcgcgtt

SEQ ID NO: 231220 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcttcaagctagctacctccattgtctg

SEQ ID NO: 231221 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgccttgatcctcgcataatatgatacgtctg

SEQ ID NO: 231222 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatacgatacgtctg

SEQ ID NO: 231223 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatgcatgtag

SEQ ID NO: 231224 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactacccccatcgagcggtttaccggttggcgacaacgc

SEQ ID NO: 231225 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcctctgctctccctctcggatcgcgtacgtggatatg

SEQ ID NO: 231226 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcgctggaccacccgtgtta

SEQ ID NO: 231227 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtcctcttgtggtattgcgcatgc

SEQ ID NO: 231228 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcctctgtgactctcacgctaacccgggggtgtgaccgtc

SEQ ID NO: 231229 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgctcgactgga

SEQ ID NO: 231230 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaactgggcagttac

SEQ ID NO: 231231 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcactctcggtaacttgggcagttac

SEQ ID NO: 231232 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgactccgcccatacatgcatgtaa

SEQ ID NO: 231233 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtacttgggcagttac

SEQ ID NO: 231234 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttccggtaacttgggcagttac

SEQ ID NO: 231235 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcctatacatgcatgtaa

SEQ ID NO: 231236 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgttagcccttccggaatg

SEQ ID NO: 231237 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtgttgcgcatgc

SEQ ID NO: 231238 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagtcttctggcactatccagttgacgctca

SEQ ID NO: 231239 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgttcgccagtcacatcaactatgatgacgcttgactgga

SEQ ID NO: 231240 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgctgcctttattcgtctgatgatgtgcacctcgagt

SEQ ID NO: 231241 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgcctcgcttgtgcacaactcgcatcccgcgtctgcg

SEQ ID NO: 231242 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctaccttcattgtctg

SEQ ID NO: 231243 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctaactacctccattgtctg

SEQ ID NO: 231244 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctagctacctccattgtcctg

SEQ ID NO: 231245 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttatgacgtcggttcgcctcgggtccatcccaattgtctg

SEQ ID NO: 231246 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccaatgaccggatcagggtatatcacagactactgtgag

SEQ ID NO: 231247 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttacacacttctcggtaacttgggcagttac

SEQ ID NO: 231248 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgggacgcctcgatcctcgcataatatgatacgtctg

SEQ ID NO: 231249 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctggccgacatgcatgattgcctgggagtccccacaatgt

SEQ ID NO: 231250 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agttttctcggatccaaacgcatatcctcctccgcctcgt

SEQ ID NO: 231251 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaacttgggcagtac

SEQ ID NO: 231252 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttagacacttctcggtaacttgggcagttac

SEQ ID NO: 231253 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataacatgatacgtctg

SEQ ID NO: 231254 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtgcgcctcgattccgcccatacatgcatgtaa

SEQ ID NO: 231255 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcggttccgcccatacatgcatgtaa

SEQ ID NO: 231256 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacgtgcatgtaa

SEQ ID NO: 231257 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattttctaggcctacgccgcctgggctcctccgtatgcg

SEQ ID NO: 231258 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcgtgc

SEQ ID NO: 231259 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtactgcgcatgc

SEQ ID NO: 231260 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctcctttgtctg

SEQ ID NO: 231261 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccagggcccgcctcaagctagctacctccattgtctg

SEQ ID NO: 231262 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgccttgattccgcccatacatgcatgtaa

SEQ ID NO: 231263 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaaccgggcccgcctcaagctagctacctccattgtctg

SEQ ID NO: 231264 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcgggacgtctttcgtgcactatcacgatt

SEQ ID NO: 231265 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactatcacgatc

SEQ ID NO: 231266 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagccagctacctccattgtctg

SEQ ID NO: 231267 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgccttcaagctagctacctccattgtctg

SEQ ID NO: 231268 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactcgccagtcacatcaactatgatgacgcttgactgga

SEQ ID NO: 231269 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccggcactggaggcgtccctggtggactaccaccttat

SEQ ID NO: 231270 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcttatccggcaggacgtctttcgtgcactatcacgatt

SEQ ID NO: 231271 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcgtaatatgatacgtctg

SEQ ID NO: 231272 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccacccatacatgcatgtaa

SEQ ID NO: 231273 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaataaccttccgttactcgcctcgggcaagtgtgcgca

SEQ ID NO: 231274 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgcgcactatcacgatt

SEQ ID NO: 231275 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccgacaggacgtctttcgtgcactatcacgatt

SEQ ID NO: 231276 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgttacgccttccggaatg

SEQ ID NO: 231277 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catcccggtggttcgtgttcagcaacgctccttaacacga

SEQ ID NO: 231278 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcatcgagctttcgtccgggagtgtatagcta

SEQ ID NO: 231279 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcctgcctcaagctagctacctccattgtctg

SEQ ID NO: 231280 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagcgacctccattgtctg

SEQ ID NO: 231281 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgaatcctgctttaggcgcctcttaagggatccattttt

SEQ ID NO: 231282 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatccgccagtcacatcaactatgatgacgcttgactgga

SEQ ID NO: 231283 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgtataatatgatacgtctg

SEQ ID NO: 231284 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtcttccgtgcactatcacgatt

SEQ ID NO: 231285 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacatctttcgtgcactatcacgatt

SEQ ID NO: 231286 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctctcggctcccgtgcgcacgcagctgactcgaactg

SEQ ID NO: 231287 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atctccgtctaacacgtgcactatcacggctttagttaga

SEQ ID NO: 231288 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ataggtcctggggtatccgcctcgctaagtttgtgcatgc

SEQ ID NO: 231289 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaactggggcccgcctcaagctagctacctccattgtctg

SEQ ID NO: 231290 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctcccaagtttagtcgtctttcgaggactacctcgtttc

SEQ ID NO: 231291 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccccttcatcggaattgataactcaccccgttgtcttga

SEQ ID NO: 231292 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcggagtgctcatgagc

SEQ ID NO: 231293 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatgcatgcaa

SEQ ID NO: 231294 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggactgtacccgaactgggtt

SEQ ID NO: 231295 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacactgccctttgtttaaggcctttatacaaacgca

SEQ ID NO: 231296 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcatac

SEQ ID NO: 231297 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaataggacctacgcccgcctcagtctgactcatcgtctg

SEQ ID NO: 231298 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggctcgcctcaagctagctacctccattgtctg

SEQ ID NO: 231299 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttgtccgtcctctcgtggtattgcgcatgc

SEQ ID NO: 231300 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcatgatatgatacgtctg

SEQ ID NO: 231301 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgatacgcctg

SEQ ID NO: 231302 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatgcgtgtaa

SEQ ID NO: 231303 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatggtccatgagcttctggcactatccagttgacgctca

SEQ ID NO: 231304 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttgtccggcaggacgtctttcgtgcactatcacgatt

SEQ ID NO: 231305 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtccttcgtgcactatcacgatt

SEQ ID NO: 231306 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccggaagtccctcctcgtcttgatgcactatcatctca

SEQ ID NO: 231307 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttggtcatcccctacatgtaggcctatgtctggca

SEQ ID NO: 231308 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgcggtattgcgcatgc

SEQ ID NO: 231309 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttatggtattgcgcatgc

SEQ ID NO: 231310 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgcccgtcctcttgtggtattgcgcatgc

SEQ ID NO: 231311 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgcttgttgcaa

SEQ ID NO: 231312 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccattgtttg

SEQ ID NO: 231313 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtagatcgttcttatccgcctcggtcttccccgggttaa

SEQ ID NO: 231314 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcactttctcggtaacttgggcagttac

SEQ ID NO: 231315 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatccccgcataatatgatacgtctg

SEQ ID NO: 231316 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgatttccgccatacatgcatgtaa

SEQ ID NO: 231317 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgccatacatgcatgtaac

SEQ ID NO: 231318 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatctggcaggacgtctttcgtgcactatcacgatt

SEQ ID NO: 231319 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtcttaacgtgttcccttcggacatccatcaa

SEQ ID NO: 231320 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgtacgtgagattgcctcgctactctcttttgcagctg

SEQ ID NO: 231321 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actaccatcgtctagcgagcgaatgaaaatcgtcactgtt

SEQ ID NO: 231322 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgtcgacaccgcctctgtccgtatgaccggtctcgtctg

SEQ ID NO: 231323 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acccgcttgtgtgcgacacatgtctacgactcctcttcag

SEQ ID NO: 231324 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccattgtcag

SEQ ID NO: 231325 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaaactagctacctccattgtctg

SEQ ID NO: 231326 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctagctaccttccattgtctg

SEQ ID NO: 231327 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatctcgagcgag

SEQ ID NO: 231328 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgagccatggatcactgcctcgattcgtccacgtggtggc

SEQ ID NO: 231329 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttatacacttctcggtaacttgggcagttac

SEQ ID NO: 231330 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttgagcagttac

SEQ ID NO: 231331 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcggtaacttgggcagttac

SEQ ID NO: 231332 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttgggcagttacc

SEQ ID NO: 231333 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcgttttaagcacttctcggtaacttgggcagttac

SEQ ID NO: 231334 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacggcgtgtatcagttggctg

SEQ ID NO: 231335 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattcacgttgaatcgccttgctcctcctagtctg

SEQ ID NO: 231336 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggggtatctgatatgctgttatatttttggaacctctctt

SEQ ID NO: 231337 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttacccggcaggacgtctttcgtgcactatcacgatt

SEQ ID NO: 231338 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctcatccggcaggacgtctttcgtgcactatcacgatt

SEQ ID NO: 231339 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgttagccttccggaactg

SEQ ID NO: 231340 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaaccgcgttagccttccggaatg

SEQ ID NO: 231341 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtagtattgcgcatgc

SEQ ID NO: 231342 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attacagcgcccagaatgccccgtttcccgtgttcgggat

SEQ ID NO: 231343 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgactgcaggcatttgcctcgtgtttgtatcacgtgaga

SEQ ID NO: 231344 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acctaggctgcctcgaccctccaaagctcggtccttttga

SEQ ID NO: 231345 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatctcgagcgga

SEQ ID NO: 231346 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatcccgagcgaa

SEQ ID NO: 231347 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaacttgggcagtta

SEQ ID NO: 231348 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgcgtatcagttggctg

SEQ ID NO: 231349 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgatacgtcta

SEQ ID NO: 231350 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgatacatctg

SEQ ID NO: 231351 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattctgcccatacatgcatgtaa

SEQ ID NO: 231352 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgccccgattccgcccatacatgcatgtaa

SEQ ID NO: 231353 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatgggctttaagcacttctcggtaacttgggcagttac

SEQ ID NO: 231354 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttgcttctcctgactacatgagattaataaacgcgc

SEQ ID NO: 231355 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactatcgcgatt

SEQ ID NO: 231356 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactatcacggtt

SEQ ID NO: 231357 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccaagacgattgtcgttattgccggactacctgcattt

SEQ ID NO: 231358 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtcatcttcactggacacccgtgtta

SEQ ID NO: 231359 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacagctcacttcgtctttgatcgaccacgctcataa

SEQ ID NO: 231360 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtctaaccgtttgttgcaa

SEQ ID NO: 231361 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacgagatctcatgacgcctcgggtccttccttcgactg

SEQ ID NO: 231362 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctaccaccattgtctg

SEQ ID NO: 231363 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccacctcaagctagctacctccattgtctg

SEQ ID NO: 231364 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggaccgcctcaagctagctacctccattgtctg

SEQ ID NO: 231365 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagtctagctacctccattgtctg

SEQ ID NO: 231366 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcttatccggcaggacgtctttcgtgcactatcacgatt

SEQ ID NO: 231367 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgggatacttgaggtcgttgtgcgcttacgaaccctaat

SEQ ID NO: 231368 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgacgcttggctgga

SEQ ID NO: 231369 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttcgtgatacttgggcagttac

SEQ ID NO: 231370 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcggtaacttggcgagttac

SEQ ID NO: 231371 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcgggcacgacgtgtatcagttggctg

SEQ ID NO: 231372 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcaccggacacgacgtgtatcagttggctg

SEQ ID NO: 231373 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacacgcatgtaa

SEQ ID NO: 231374 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgtcagtctcgtcttcccatcgtctgcatttgacggac

SEQ ID NO: 231375 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcctcggtctacccctaatgttgcaacataatggtaaa

SEQ ID NO: 231376 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcagtccgtggatccactttgcacgtgccatgaca

SEQ ID NO: 231377 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgcaagccatgctctagacgcctcaaaaagatgatgct

SEQ ID NO: 231378 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgttgaatgttatccgccttgcttccgtccctaagctg

SEQ ID NO: 231379 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attccgtttagagaaatctgttggccactatgccatcaat

SEQ ID NO: 231380 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgattcttcctcagcttccgcggtgcaggatttgcacgt

SEQ ID NO: 231381 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctagcctacctccattgtctg

SEQ ID NO: 231382 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaaaccgcatctcgagcgaa

SEQ ID NO: 231383 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttctgggaatgccgcatctcgagcgaa

SEQ ID NO: 231384 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacactattttctgggaagccgcatctcgagcgaa

SEQ ID NO: 231385 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcagcgcgcacgccttgtctatccctgggtggccaccata

SEQ ID NO: 231386 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgacgcttgactggg

SEQ ID NO: 231387 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggttcgaaccggtatgcata

SEQ ID NO: 231388 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgccatacattgcatgtaa

SEQ ID NO: 231389 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccatggtacgcctcgattccgcccatacatgcatgtaa

SEQ ID NO: 231390 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcgcgctgccctttgtttaaggcctttatacaaacgca

SEQ ID NO: 231391 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctggcgtactacttggacaggttcctcc

SEQ ID NO: 231392 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggatgtctttcgtgcactatcacgatt

SEQ ID NO: 231393 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactaccacgatt

SEQ ID NO: 231394 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccagcaggacgtctttcgtgcactatcacgatt

SEQ ID NO: 231395 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgcagcctcggtcctacacagcatggccatgccgttat

SEQ ID NO: 231396 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattcgccagtcacatcaactatgatgacgcttgactgga

SEQ ID NO: 231397 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggcattgcgcatgc

SEQ ID NO: 231398 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtctctcactacgcgtatggaatc

SEQ ID NO: 231399 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactacccgtttgtccgtcctcttgtggtattgcgcatgc

SEQ ID NO: 231400 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacctgtagtcgtcccgtgcgtgtgggtcgaaatgccgct

SEQ ID NO: 231401 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atctgcgccgggttctcattctcccgactacgtgagatta

SEQ ID NO: 231402 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accacacgtgtgatgcgcctccggtcctcgtttgtctgta

SEQ ID NO: 231403 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctcaattgtctg

SEQ ID NO: 231404 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgttcgccagccacatcaactatgatgacgcttgactgga

SEQ ID NO: 231405 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgctagtcacatcaactatgatgacgcttgactgga

SEQ ID NO: 231406 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactcgccagccacatcaactatgatgacgcttgactgga

SEQ ID NO: 231407 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccggaagtccctcctcgtcttgatgcactatcatctca

SEQ ID NO: 231408 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacgcgacgtgtatcagttggctg

SEQ ID NO: 231409 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatcggttggctg

SEQ ID NO: 231410 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacacaggtgttaattgcctccggtccttccgtgtgcaca

SEQ ID NO: 231411 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taatctggtacctatcatgcgctatcatgacggctaggac

SEQ ID NO: 231412 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcgtggttcgaaccggtatgcatg

SEQ ID NO: 231413 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatccttgcataatatgatacgtctg

SEQ ID NO: 231414 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgccccgatcctcgcataatatgatacgtctg

SEQ ID NO: 231415 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgcctcgatcctcgcattaatatgatacgtctg

SEQ ID NO: 231416 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattcacgttgaaccgccttgctcctcttagtctg

SEQ ID NO: 231417 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggcttccacgcacgcggattgtacccgaactgggtt

SEQ ID NO: 231418 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcaagattcatctttgcttgactacacgcaattccgatga

SEQ ID NO: 231419 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctggccggattcgccttggtcctaccgtgttgcaacagac

SEQ ID NO: 231420 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactatcacgatg

SEQ ID NO: 231421 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctccaggttcccctaacgcgttagccttccggaatg

SEQ ID NO: 231422 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccatgatttcctcctacctgggtagccgcgcgttgctag

SEQ ID NO: 231423 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattgtggacctcctttctcggatccaaacacaattgcac

SEQ ID NO: 231424 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagtgttatggcgatcggattgccctcaccctgaccgctg

SEQ ID NO: 231425 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgccctcttgtggtattgcgcatgc

SEQ ID NO: 231426 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgcgaactgctgttttggcgctatccaaattttaggcta

SEQ ID NO: 231427 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgaccggtcccgcctcataattcccgctttgctacgtgg

SEQ ID NO: 231428 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agactactccgatggacaatcgtaacttaggagtcgccta

SEQ ID NO: 231429 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgtcagcctcggttatcttacgcgtacctctcatgcgca

SEQ ID NO: 231430 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagctgacgcctttgactctccatgttgccggcacggac

SEQ ID NO: 231431 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acaccaacactctgtatacgctggactacccgcgtttcaa

SEQ ID NO: 231432 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgtctcaagctagctacctccattgtctg

SEQ ID NO: 231433 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgctcaagctagctacctccattgtcctg

SEQ ID NO: 231434 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgccttaagctagctacctccattgtctg

SEQ ID NO: 231435 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccatagtctg

SEQ ID NO: 231436 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctacagctagctacctccattgtctg

SEQ ID NO: 231437 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttccggaacgcctcgatcctcgcataatatgatacgtctg

SEQ ID NO: 231438 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcacctcgagcgaa

SEQ ID NO: 231439 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacctcgtctttgatcgaccacgctcataa

SEQ ID NO: 231440 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaacttgggcattac

SEQ ID NO: 231441 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttgggcagcttac

SEQ ID NO: 231442 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcctttaagcacttctcggtaacttgggcagttac

SEQ ID NO: 231443 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatcagttggccg

SEQ ID NO: 231444 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgatacgtccg

SEQ ID NO: 231445 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccttacatgcatgtaa

SEQ ID NO: 231446 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcaattccgcccatacatgcatgtaa

SEQ ID NO: 231447 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcgcgcacgcggattgtacccgaactgggtt

SEQ ID NO: 231448 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcagaataaattcctcccactgctcgcctcgcatgctata

SEQ ID NO: 231449 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggccttaatacaaacgca

SEQ ID NO: 231450 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcagaacgtctttcgtgcactatcacgatt

SEQ ID NO: 231451 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgtggaacctccgattgctag

SEQ ID NO: 231452 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactgtccgtttgtccgtcctcttgtggtattgcgcatgc

SEQ ID NO: 231453 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttcgtccgtcctcttgtggtattgcgcatgc

SEQ ID NO: 231454 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctctcgtggtattgcgcatgc

SEQ ID NO: 231455 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcatcgacgcgttagtcttgctgtcatgcagc

SEQ ID NO: 231456 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcatctatccagttgacgctca

SEQ ID NO: 231457 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcggtccatgagcttctggcactatccagttgacgctca

SEQ ID NO: 231458 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcatgggtcggttttggtgggggactacccccttgta

SEQ ID NO: 231459 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacgctgccctttgtttaaggcctttatacaaacgca

SEQ ID NO: 231460 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttattcctgatgatccgaattctcatcggctggcactatc

SEQ ID NO: 231461 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccacatctcgagcgaa

SEQ ID NO: 231462 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgccgcctcatcatcggacacgacgtgtatcagttggctg

SEQ ID NO: 231463 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcgcagctcacttcgtctttgatcgaccacgctcataa

SEQ ID NO: 231464 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcagctgctcctgcctgaaatcgtgttccctaacgttaag

SEQ ID NO: 231465 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacgtcaactatgatgacgcttgactgga

SEQ ID NO: 231466 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatggtgacgcttgactgga

SEQ ID NO: 231467 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgacgacgcttgactgga

SEQ ID NO: 231468 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaaccatgatgacgcttgactgga

SEQ ID NO: 231469 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcattctcggtaacttgggcagttac

SEQ ID NO: 231470 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaattgggcagttac

SEQ ID NO: 231471 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttctagcacttctcggtaacttgggcagttac

SEQ ID NO: 231472 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaaccttgggcagttac

SEQ ID NO: 231473 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaaagcactttctgggataccgtggcagtac

SEQ ID NO: 231474 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgcctcatcatcggacacgacgtgtatcagttggctg

SEQ ID NO: 231475 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagagtgctcatgggc

SEQ ID NO: 231476 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagcgggttttaagcacttctcggtaacttgggcagttac

SEQ ID NO: 231477 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacgggcttttaagcacttctcggtaacttgggcagttac

SEQ ID NO: 231478 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatcagttggcta

SEQ ID NO: 231479 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcgaacacgacgtgtatcagttggctg

SEQ ID NO: 231480 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacagaggccctcgtgttggactaccaacttgtagagcgg

SEQ ID NO: 231481 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggttcgaaccggcatgcatg

SEQ ID NO: 231482 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggttcgaaccagtatgcatg

SEQ ID NO: 231483 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctcagtcctcatggttcgaaccggtatgcatg

SEQ ID NO: 231484 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgaatcgcctcgactctcgacataatatgatacgtctg

SEQ ID NO: 231485 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgataagtctg

SEQ ID NO: 231486 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataaaatgatacgtctg

SEQ ID NO: 231487 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacacctcgatcctcgcataatatgatacgtctg

SEQ ID NO: 231488 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatacatgtaa

SEQ ID NO: 231489 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcctcgattcctcaggtctcgtgatccatgcaattgcat

SEQ ID NO: 231490 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccttcgtctagcggcgctctgtggtaagattctact

SEQ ID NO: 231491 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcatcctcatgacggtctgttgatggctacatcattgttc

SEQ ID NO: 231492 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctggcgcactacttggacaggttccttc

SEQ ID NO: 231493 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgtagtgattcctaaaggctcctagtggctgggactacc

SEQ ID NO: 231494 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcaccatcacgatt

SEQ ID NO: 231495 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctctcgtgcactatcacgatt

SEQ ID NO: 231496 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggcgaccgtccatcgagcggtatcgtgtgtcgcgtatga

SEQ ID NO: 231497 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtatcgagcggtcggtccgtgccctaaaccca

SEQ ID NO: 231498 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccggcctcaggttcccctaacgcgttagccttccggaatg

SEQ ID NO: 231499 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcagtcctggtggtaccacaacgcattgctctttt

SEQ ID NO: 231500 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccctctatagtcgtcggcgtagcacgctattgctttgaag

SEQ ID NO: 231501 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctctcggacgtcatttctgcctcgttcctctcgtttg

SEQ ID NO: 231502 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtaatgcgcatgc

SEQ ID NO: 231503 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgaaatcgagcgagaactctggtgttggcgcag

SEQ ID NO: 231504 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caaccggggcccgcctcaagctagctacctccattgtctg

SEQ ID NO: 231505 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attgattcttattggtggcacactattgccttgaacttta

SEQ ID NO: 231506 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attctaggtgacgccttggttctaccgcaaacgtttgctg

SEQ ID NO: 231507 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaactccagcgacttcggtggtgtcctctccattacca

SEQ ID NO: 231508 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgacgcttctggcatctatccagttgacgctca

SEQ ID NO: 231509 - skipped

SEQ ID NO: 231510 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgttctcgtataattcaggatggcttattatctagct

SEQ ID NO: 231511 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acggtttcttctcctgactacatgagattaataaacgcgc

SEQ ID NO: 231512 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgattcttcctcagcctccgcggtgcaggatttgcacgt

SEQ ID NO: 231513 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgttcaaccgtttgttgcaa

SEQ ID NO: 231514 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgggcttttaagcacttctcggtaacttgggcagttac

SEQ ID NO: 231515 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattccgcccctctgatgaaaccggttactt

SEQ ID NO: 231516 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacctgggcccgcctcaagctagctacctccattgtctg

SEQ ID NO: 231517 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccggcctcaagctagctacctccattgtctg

SEQ ID NO: 231518 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaacgctagctacctccattgtctg

SEQ ID NO: 231519 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacccgggcccgcctcaagctagctacctccattgtctg

SEQ ID NO: 231520 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacggctcacttcgtctttgatcgaccacgctcataa

SEQ ID NO: 231521 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcggccacgctcataa

SEQ ID NO: 231522 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccacgctcatag

SEQ ID NO: 231523 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagcccacttcgtctttgatcgaccacgctcataa

SEQ ID NO: 231524 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccgaatgcatgcggactgcctcataagtgcacaatctac

SEQ ID NO: 231525 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttgaccgga

SEQ ID NO: 231526 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttgagcacttctcggtaacttgggcagttac

SEQ ID NO: 231527 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcgtttaagcacttctcggtaacttgggcagttac

SEQ ID NO: 231528 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataggcctgtcttttaatctcggcagagtgctcatgagc

SEQ ID NO: 231529 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagggcgttttaagcacttctcggtaacttgggcagttac

SEQ ID NO: 231530 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtaccagttggctg

SEQ ID NO: 231531 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgccccatcatcggacacgacgtgtatcagttggctg

SEQ ID NO: 231532 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacaagcctgtcttttaatctcggcagagtgctcatgagc

SEQ ID NO: 231533 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaattgggccctgattacgcctcggtccttgcattaccg

SEQ ID NO: 231534 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgagaagcgtgtgagagactactctgtttgtaacgcaat

SEQ ID NO: 231535 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcttcgatcctcgcataatatgatacgtctg

SEQ ID NO: 231536 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcatatatcgatacgtctg

SEQ ID NO: 231537 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgatacgtcgg

SEQ ID NO: 231538 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgaccctcgcataatatgatacgtctg

SEQ ID NO: 231539 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcaatcctcgcataatatgatacgtctg

SEQ ID NO: 231540 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccacggtacgcctcgattccgcccatacatgcatgtaa

SEQ ID NO: 231541 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatctttatcccgcccctctgcatggtgggcctacatcg

SEQ ID NO: 231542 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtacccgagctgggtt

SEQ ID NO: 231543 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttccttctcctgactacatgagattaataaacgcgc

SEQ ID NO: 231544 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgcttgcccttgtttaaggcctttatacaaacgca

SEQ ID NO: 231545 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactacctgcatcgagcggacgaagacgagagatgctcgt

SEQ ID NO: 231546 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgactacaccctgcaaatcgccgttccccctgattctcg

SEQ ID NO: 231547 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtaggacgtctttcgtgcactatcacgatt

SEQ ID NO: 231548 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtcttttgtgcactatcacgatt

SEQ ID NO: 231549 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactatcacgact

SEQ ID NO: 231550 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccccgacgggattgagcgtatggtggactaccacctct

SEQ ID NO: 231551 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctctggctccgaatccacgttcggttctcacatcgccg

SEQ ID NO: 231552 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctctcgtggtattgcgcatgc

SEQ ID NO: 231553 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctctgtttacccgtggaacgttcctttaaccggtta

SEQ ID NO: 231554 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgagtcatcccatggcccgggcataacggaacta

SEQ ID NO: 231555 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcacatgc

SEQ ID NO: 231556 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgaggtattgcgcatgc

SEQ ID NO: 231557 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcatggtattgcgcatgc

SEQ ID NO: 231558 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctagtggtattgcgcatgc

SEQ ID NO: 231559 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtgccattgagcttctggcactatccagttgacgctca

SEQ ID NO: 231560 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgagcttctggacactatccagttgacgctcga

SEQ ID NO: 231561 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgagctctggacactatccagttgacgtctcga

SEQ ID NO: 231562 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactatccagtttgacgctca

SEQ ID NO: 231563 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagccttctggcactatccagttgacgctca

SEQ ID NO: 231564 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agcggccgattcgccttgatcctactgagctcatgttatg

SEQ ID NO: 231565 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acctgcttgtgtgcgacacatgtctacgactcctcttcag

SEQ ID NO: 231566 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acccgctgagcatgggcaatgctcaccttggactcctcct

SEQ ID NO: 231567 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatggggctttaagcacttctcggtaacttgggcagttac

SEQ ID NO: 231568 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattctgcccctctgatggaaccggttactt

SEQ ID NO: 231569 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaatcggggcccgcctcaagctagctacctccattgtctg

SEQ ID NO: 231570 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggtgcccgcctcaagctagctacctccattgtctg

SEQ ID NO: 231571 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgccttcaagctagctacctccattgctg

SEQ ID NO: 231572 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctctagctagctacctccattgtctg

SEQ ID NO: 231573 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagttagctacctccattgtctg

SEQ ID NO: 231574 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagttacctccattgtctg

SEQ ID NO: 231575 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagatacctccattgtctg

SEQ ID NO: 231576 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggccgcctcaagtctagctaccgtccattgtctg

SEQ ID NO: 231577 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttggtgcgcaacaaccgcctttgcgccattaactagttaa

SEQ ID NO: 231578 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaagcgctattttctgggaagccgcatctcgagcgaa

SEQ ID NO: 231579 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatctcgggcgaa

SEQ ID NO: 231580 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgattaacataag

SEQ ID NO: 231581 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccggaacgcctatttcttcccacggtgcacctatgttgt

SEQ ID NO: 231582 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccctctgcattgtctcgtggactaccacgacaccacaag

SEQ ID NO: 231583 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaaccatgatgacgcttgactgga

SEQ ID NO: 231584 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacaccaactatgatgacgcttgactgga

SEQ ID NO: 231585 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgacacttgactgga

SEQ ID NO: 231586 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttgggcggttac

SEQ ID NO: 231587 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagggtgctcatgagc

SEQ ID NO: 231588 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagggtacgatgaagagacccaatcgcccctctgtgcgcg

SEQ ID NO: 231589 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcgtcggacacgacgtgtatcagttggctg

SEQ ID NO: 231590 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgcatcagttggctg

SEQ ID NO: 231591 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtccttatggttcgaaccggtatgcatg

SEQ ID NO: 231592 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggttcgaaccggtatgcgtg

SEQ ID NO: 231593 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcacggttcgaaccggtatgcatg

SEQ ID NO: 231594 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtccccatggttcgaaccggtatgcatg

SEQ ID NO: 231595 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaatgcctcgatcctcgcataatatgatacgtctg

SEQ ID NO: 231596 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcggtcctcgcataatatgatacgtctg

SEQ ID NO: 231597 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcatcatatgatacgtctg

SEQ ID NO: 231598 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgatacgtcag

SEQ ID NO: 231599 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgcctcgatcctcgacataatatgatacgtctg

SEQ ID NO: 231600 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccctacatgcatgtaa

SEQ ID NO: 231601 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatgcacgtaa

SEQ ID NO: 231602 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacacctcgattccgcccatacatgcatgtaa

SEQ ID NO: 231603 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatagtacgcctcgattccgcccatacatgcatgtaa

SEQ ID NO: 231604 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccagaacgcctcgatcctcgcataatatgatacgtctg

SEQ ID NO: 231605 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcaccgctgggtgaggagtcgttgtgcgctatcacatct

SEQ ID NO: 231606 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcttgtggcactattcacagacttagccttaatctgcggt

SEQ ID NO: 231607 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcctcagtcgctccaggaattccgtagatgctagcag

SEQ ID NO: 231608 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatctactcatcaggcgctatcctgaacaccgatagtacg

SEQ ID NO: 231609 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcggagactactccgttggtctgcaggtgtcaccacga

SEQ ID NO: 231610 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggcccttatacaaacgca

SEQ ID NO: 231611 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactactcgcatcgagcaagtcttatgaggcctactactt

SEQ ID NO: 231612 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcttatccggcaggactctttcgtgcactatcacgatt

SEQ ID NO: 231613 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactatcatgatt

SEQ ID NO: 231614 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactatcacaatt

SEQ ID NO: 231615 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtagatccgtcactcactacgcgtatggaatc

SEQ ID NO: 231616 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgccacctcggatctgaccgcaatatcatgatatgtca

SEQ ID NO: 231617 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgtatcctccggtaattaccacgtacgtacatgtctg

SEQ ID NO: 231618 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttggtccccatcagctagctagatacacgtgtgaa

SEQ ID NO: 231619 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcttccggacatgtcctatcccttgcgtgcttctg

SEQ ID NO: 231620 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgccgttagccttccggaatg

SEQ ID NO: 231621 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgtagtccttctccaaacggagccgaaattcggtacta

SEQ ID NO: 231622 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtgcgcttatgggagccgggtaccttccagcaagg

SEQ ID NO: 231623 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacttatccgttgtccgtcctcttgtggtattgcgcatgc

SEQ ID NO: 231624 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactccgtcagaagatcgttcgtggggcactatccccttc

SEQ ID NO: 231625 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcatgt

SEQ ID NO: 231626 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgagcatgc

SEQ ID NO: 231627 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattacgcatgc

SEQ ID NO: 231628 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtatcgcgcatgc

SEQ ID NO: 231629 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtattgcgcatgtc

SEQ ID NO: 231630 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgtgcttccaatatgcatctcggacattcctcctcccg

SEQ ID NO: 231631 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccgcctcatcatcggacacgacgtgtatcagttggctg

SEQ ID NO: 231632 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtgtcatatatctgactacagattttgtcatggcacta

SEQ ID NO: 231633 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactatcccagttgacgctca

SEQ ID NO: 231634 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aattctagaacctgcctcaagccggcaatcacctcttctg

SEQ ID NO: 231635 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacgtactccatccgcctgggctcctcccagctacgactg

SEQ ID NO: 231636 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggggccgcctcaagctagctacctccattgtctg

SEQ ID NO: 231637 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcgtcaagctagctacctccattgtctg

SEQ ID NO: 231638 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgccacaagctagctacctccattgtctg

SEQ ID NO: 231639 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagcctagctacctccattgtctg

SEQ ID NO: 231640 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgctcctgcgttacgtctgtgatcgactaccttcataat

SEQ ID NO: 231641 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcgcgtatagcctcggttcttccatgcagctgcatatta

SEQ ID NO: 231642 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttatccctgacgatccgaattctcatcggctggcactatc

SEQ ID NO: 231643 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttagggctttaagcacttctcggtaacttgggccagttac

SEQ ID NO: 231644 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtggggctttaagcacttctcggtaacttgggcagttac

SEQ ID NO: 231645 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcggaacgctattttctgggaagccgcatctcgagcgaa

SEQ ID NO: 231646 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgattcactcctacagtgtgtctatagg

SEQ ID NO: 231647 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctggggagccgcatctcgagcgaa

SEQ ID NO: 231648 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaggccgcatctcgagcgaa

SEQ ID NO: 231649 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcgtcccgagcgaa

SEQ ID NO: 231650 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttctgggaagcccgcatctcgagcgaa

SEQ ID NO: 231651 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttcctgggaagccgcatctcgagcgaa

SEQ ID NO: 231652 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgccgcctccgatcctccattgggtggccataccattgta

SEQ ID NO: 231653 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttgctagcggattcgtctcgatccccccatgcgctgta

SEQ ID NO: 231654 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgactacgctcataa

SEQ ID NO: 231655 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcctccatctggtcgcgatacagaatacgattaacataaa

SEQ ID NO: 231656 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcattgattgaccgcccctctgatcgccaaccggttacga

SEQ ID NO: 231657 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcgcatcaactatgatgacgcttgactgga

SEQ ID NO: 231658 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcagctatgatgacgcttgactgga

SEQ ID NO: 231659 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcctgactgga

SEQ ID NO: 231660 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactacgatgacgcttgactgga

SEQ ID NO: 231661 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcgactatgatgacgcttgactgga

SEQ ID NO: 231662 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcagctatgatgacgcttgactgga

SEQ ID NO: 231663 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaaagcactttctcggtaacttggcagttac

SEQ ID NO: 231664 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacggggctttaagcacttctcggtaacttgggcagttac

SEQ ID NO: 231665 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcgtcatcggacacgacgtgtatcagttggctg

SEQ ID NO: 231666 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtattagttggctg

SEQ ID NO: 231667 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatcgatgtgctg

SEQ ID NO: 231668 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatcagttgactg

SEQ ID NO: 231669 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatcagtcggctg

SEQ ID NO: 231670 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatcagctggctg

SEQ ID NO: 231671 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggttcgagccggtatgcatg

SEQ ID NO: 231672 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgtaatcgattcgctgcgcctcggtccaaccatgcgttg

SEQ ID NO: 231673 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgtggtacgcctcgattccgcccatacatgcatgtaa

SEQ ID NO: 231674 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcccgttgtgggttgatttgcgcgtactagtgccatcga

SEQ ID NO: 231675 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtacccgaactgggta

SEQ ID NO: 231676 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggatcgtacccgaactgggtt

SEQ ID NO: 231677 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacacggattgtacccgaactgggtt

SEQ ID NO: 231678 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggcctttgtacaaacgca

SEQ ID NO: 231679 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggcctttatacaagcgca

SEQ ID NO: 231680 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgcttaaggcctttatacaaacgca

SEQ ID NO: 231681 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctctgtttaaggcctttatacaaacgca

SEQ ID NO: 231682 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaccatggtacgcctcgattccgcccatacatgcatgtaa

SEQ ID NO: 231683 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttggacgtccaactgttgcctcgactcctccatcggata

SEQ ID NO: 231684 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttattcggcaggacgtctttcgtgcactatcacgatt

SEQ ID NO: 231685 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactgtcacgatt

SEQ ID NO: 231686 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactatcacgata

SEQ ID NO: 231687 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgactttcgtgcactatcacgatt

SEQ ID NO: 231688 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatcccgcaggacgtctttcgtgcactatcacgatt

SEQ ID NO: 231689 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatcaggcaggacgtctttcgtgcactatcacgatt

SEQ ID NO: 231690 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccaccgtgcaagtcatttacgcagactactgcgacgct

SEQ ID NO: 231691 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcatatccggcaggacgtctttcgtgcactatcacgatt

SEQ ID NO: 231692 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctacgaactagtggtctttgtgcgtttaagacccgtcgat

SEQ ID NO: 231693 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctcttcgctcccacagatctgtattttggctgtctaga

SEQ ID NO: 231694 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgagcagtgtgccgttttcggtg

SEQ ID NO: 231695 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgaaacgctattttctgggaagccgcatctcgagcgaa

SEQ ID NO: 231696 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccgcctcagtttatcccgaactaaggttgtatacgaca

SEQ ID NO: 231697 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctgctattagccactatgctatttcatacagtgccgtac

SEQ ID NO: 231698 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcggatacccacccatgggcatgctagcatggcaatta

SEQ ID NO: 231699 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcgtgaggacttgattggctacaatctcgacgtc

SEQ ID NO: 231700 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtacttgtcgcacctcgtacttggcggctgacgctatt

SEQ ID NO: 231701 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgatcgggatacatgtacactctcttaacgcgtt

SEQ ID NO: 231702 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactgggccacccgtgtta

SEQ ID NO: 231703 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccctcttcgtcacacgtcggggactaccccgaaagaagtg

SEQ ID NO: 231704 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccactaaaggtacctagtccccgtgtcgcctcccagtctg

SEQ ID NO: 231705 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagtcaatgttcatcgagcgagttatattattgcataacg

SEQ ID NO: 231706 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcctcatcgatgctgagttattcgcctacgagggg

SEQ ID NO: 231707 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgttcgtcctcttgtggtattgcgcatgc

SEQ ID NO: 231708 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcttcttgtggtattgcgcatgc

SEQ ID NO: 231709 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgtatgc

SEQ ID NO: 231710 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtgatattgcgcatgc

SEQ ID NO: 231711 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccccttgtggtattgcgcatgc

SEQ ID NO: 231712 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgctcgtcctcttgtggtattgcgcatgc

SEQ ID NO: 231713 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttatccgtcctcttgtggtattgcgcatgc

SEQ ID NO: 231714 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtccttcttgtggtattgcgcatgc

SEQ ID NO: 231715 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcgatcgagcgaatcgcatcataaatcgcatg

SEQ ID NO: 231716 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactaggttcgcctcgcgcctcctcgtgcacgtttgtctg

SEQ ID NO: 231717 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgtgcagcctcgaattggcgccaccactctacactgat

SEQ ID NO: 231718 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgtttgtccgtcctcttgtggtattgcgcatgc

SEQ ID NO: 231719 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgcttgacctcctgtcgactctgcggctgagactact

SEQ ID NO: 231720 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caaattatcagggactaccctgacgcaatattcacacgct

SEQ ID NO: 231721 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactatccgagttgacgctca

SEQ ID NO: 231722 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactatccagttgacgtctca

SEQ ID NO: 231723 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgatgggcctttagacacttctcgtacttggcagttac

SEQ ID NO: 231724 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggagcgcctcgatcctcgcataatatgatacgtctg

SEQ ID NO: 231725 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcataatatggtacgtctg

SEQ ID NO: 231726 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atatgggctttaagcacttctcggtaacttgggcagttac

SEQ ID NO: 231727 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ataccggggcccgcctcaagctagctacctccattgtctg

SEQ ID NO: 231728 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agctgtcgacatctctacctctgctccttccaagtgtctg

SEQ ID NO: 231729 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agcattgttccagtcttctcccacagcggctggcactatc

SEQ ID NO: 231730 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actctcggatcattgtgcatgcacttttcgcctcgcctac

SEQ ID NO: 231731 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actaggctttcacgcacgcggattgtacccgaactgggtt

SEQ ID NO: 231732 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgattctccctcagcttccgcggtgcaggatttgcacgt

SEQ ID NO: 231733 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgattctccctcagcctccgcggtgcaggatttgcacgt

SEQ ID NO: 231734 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcctcaggttccctaacgcgttacgccttccggaatg

SEQ ID NO: 231735 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagatgcctccacaatccgcctcggtcactgatatgtat

SEQ ID NO: 231736 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttgaccgtttgttgcaa

SEQ ID NO: 231737 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aattcgccagccacatcaactatgatgacgcttgactgga

SEQ ID NO: 231738 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aactatccgtttgtccgtcctcttgtggtattgcgcatgc

SEQ ID NO: 231739 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccggggcccgcctcaagcctagctacctccattgtctg

SEQ ID NO: 231740 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgctcaagtcctagctacctcacttcgactg

SEQ ID NO: 231741 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaagcctagctacctccacttgtctg

SEQ ID NO: 231742 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctcccttgtctg

SEQ ID NO: 231743 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccattttctg

SEQ ID NO: 231744 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccattggctg

SEQ ID NO: 231745 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctagctaacctccattgtctg

SEQ ID NO: 231746 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttctagaacgcctcgcacgtacggccgaccatcgtgcatg

SEQ ID NO: 231747 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttccatggtacgcctcgattccgcccatacatgcatgtaa

SEQ ID NO: 231748 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgtaacgttacagccgtctctaaactgcagtgcaacct

SEQ ID NO: 231749 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcctcgatcctccataccgtctg

SEQ ID NO: 231750 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatctcaagcgaa

SEQ ID NO: 231751 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctactttctgggaagccgcatctcgagcgaa

SEQ ID NO: 231752 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcatgctccggagtacaccgcctgggtcttcgcgtctga

SEQ ID NO: 231753 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggcttttaagcacttctcggtaacttggcagttac

SEQ ID NO: 231754 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactaggctactactgatcacgtcg

SEQ ID NO: 231755 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctaggctttcacgcacgcggattgtacccgaactgggtt

SEQ ID NO: 231756 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcggtttcttctcctgactacatgagattaataaacgcgc

SEQ ID NO: 231757 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcactttgtctttgatcgaccacgctcataa

SEQ ID NO: 231758 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttggtcgaccacgctcataa

SEQ ID NO: 231759 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgaccgaccacgctcataa

SEQ ID NO: 231760 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtccttgatcgaccacgctcataa

SEQ ID NO: 231761 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgcctttgatcgaccacgctcataa

SEQ ID NO: 231762 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgaggactacctcgaagtacgagcgtaaacctaatcgga

SEQ ID NO: 231763 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccgcctctgtcttccagctacggtagcactataggccta

SEQ ID NO: 231764 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatttgccagtcacatcaactatgatgacgcttgactgga

SEQ ID NO: 231765 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagttacatcaactatgatgacgcttgactgga

SEQ ID NO: 231766 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactgtgatgacgcttgactgga

SEQ ID NO: 231767 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactgtgatgacgcttgactgga

SEQ ID NO: 231768 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatggtgacgcttgactgga

SEQ ID NO: 231769 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgacgcttgaccgga

SEQ ID NO: 231770 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactacgatgacgcttgactgga

SEQ ID NO: 231771 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggggcttttaagcacttcggtaacttgggcagttac

SEQ ID NO: 231772 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctgtgaacttgggcagttac

SEQ ID NO: 231773 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggcacttgggcagttac

SEQ ID NO: 231774 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagtcacttctcggtaacttggcagttac

SEQ ID NO: 231775 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttggacagttac

SEQ ID NO: 231776 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttatagcacttctcggtaacttgggcagttac

SEQ ID NO: 231777 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcactctcggttaacttgggcagttac

SEQ ID NO: 231778 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttgggcagtttac

SEQ ID NO: 231779 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttctaagcacttctcggtaacttgggcagttac

SEQ ID NO: 231780 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatccgccagccacatcaactatgatgacgcttgactgga

SEQ ID NO: 231781 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcacgctgccctttgtttaaggcctttatacaaacgca

SEQ ID NO: 231782 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcacatcaactatgatgacgcttgactgga

SEQ ID NO: 231783 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taggggcttttaagcacttctcggtaacttgggcagttac

SEQ ID NO: 231784 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacgaaacgctattttctgggaagccgcatctcgagcgaa

SEQ ID NO: 231785 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcttcatcatcggacacgacgtgtatcagttggctg

SEQ ID NO: 231786 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgccttatcatcggacacgacgtgtatcagttggctg

SEQ ID NO: 231787 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcattggacacgacgtgtatcagttggctg

SEQ ID NO: 231788 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtgtcagttggctg

SEQ ID NO: 231789 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtactcatgtgctg

SEQ ID NO: 231790 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcagacacgacgtgtatcagttggctg

SEQ ID NO: 231791 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcaccatcggacacgacgtgtatcagttggctg

SEQ ID NO: 231792 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctgcgcctctgtcctcatgttcgaaccggtatgcatg

SEQ ID NO: 231793 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggttcgaaccggtgtgcatg

SEQ ID NO: 231794 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggttcgaaccggtacgcatg

SEQ ID NO: 231795 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcggatttctcgggtcttagtgatgtacctcgcgtcccc

SEQ ID NO: 231796 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcattatatgatacgtctg

SEQ ID NO: 231797 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgttacgtctg

SEQ ID NO: 231798 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgatatgtctg

SEQ ID NO: 231799 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgatacgtttg

SEQ ID NO: 231800 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaagcgcctcgatcctcgcataatatgatacgtctg

SEQ ID NO: 231801 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgcctcgattcctcgcataatatgatacgtctg

SEQ ID NO: 231802 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcccgccttgatcctcagtcttacccaggttgcaactta

SEQ ID NO: 231803 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgtctcgattccgcccatacatgcatgtaa

SEQ ID NO: 231804 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgatttcgcccatacatgcatgtaa

SEQ ID NO: 231805 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgctcatacatgcatgtaa

SEQ ID NO: 231806 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatgcatgtat

SEQ ID NO: 231807 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatgcatgaaa

SEQ ID NO: 231808 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgccaatacatgcatgtaa

SEQ ID NO: 231809 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccaaggtacgcctcgattccgcccatacatgcatgtaa

SEQ ID NO: 231810 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcgcgcggattgtacccgaactgggtt

SEQ ID NO: 231811 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtgcccgaactgggtt

SEQ ID NO: 231812 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtatccgaactgggtt

SEQ ID NO: 231813 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtacccggactgggtt

SEQ ID NO: 231814 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtacccgaactgggtg

SEQ ID NO: 231815 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtcgattcatttcccggactacctggaacgcttggcca

SEQ ID NO: 231816 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctggctacatgagattaataaacgcgc

SEQ ID NO: 231817 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgggattaataaacgcgc

SEQ ID NO: 231818 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcctgcctcgtgcctcttgtgcttcatgaagccgcgtttg

SEQ ID NO: 231819 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcctcaggttcccctaacgcgttagccttccggaatg

SEQ ID NO: 231820 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgcctcttttacctcctgctgcagcacacagacacga

SEQ ID NO: 231821 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggcctttatgcaaacgca

SEQ ID NO: 231822 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatactcaatccggcccctctgcgataaccggttatgatg

SEQ ID NO: 231823 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaggtacatgatcgcgtttatagactactgtaattttagc

SEQ ID NO: 231824 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctggcgtactacttggacaggctccttc

SEQ ID NO: 231825 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccgggacccgcctcaagctagctacctccattgtctg

SEQ ID NO: 231826 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaaccggggccgcctcaagctagctacctccattgtctg

SEQ ID NO: 231827 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttcgtcgttgtgcaataaccttcagtggctggcgctatc

SEQ ID NO: 231828 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttagtgattttgccgcccctctgtttagtggccattgga

SEQ ID NO: 231829 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatcgggcaggacgtctttcgtgcactatcacgatt

SEQ ID NO: 231830 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcattatcacgatt

SEQ ID NO: 231831 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgaactatcacgatt

SEQ ID NO: 231832 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcctattgtgagcttctccagccgcctcaactcttgtcc

SEQ ID NO: 231833 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtcatcgagcgagcactttgtgcgatcacaca

SEQ ID NO: 231834 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggttcttcgataatatgcagca

SEQ ID NO: 231835 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtgtctggttaaacgacga

SEQ ID NO: 231836 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagcgtctggttaaacaacga

SEQ ID NO: 231837 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgctcgcctcggatcgcgcgaacttctcccgtattgcg

SEQ ID NO: 231838 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtcctcaggttcccctaacgcgttagccttccggaatg

SEQ ID NO: 231839 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgggtctttattgtcgtctttgtaggactacctgcatca

SEQ ID NO: 231840 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccggctcctcgtcctaacgtatgcataccttctgtggcca

SEQ ID NO: 231841 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttgtttccctccggatcttgtacaagatggtgttg

SEQ ID NO: 231842 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttgaacctcgttgcatgcaagaatacgaaagagta

SEQ ID NO: 231843 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcggatcgttcccaatggtggtacccccattaatg

SEQ ID NO: 231844 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgtggaaccctcgattgctag

SEQ ID NO: 231845 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcagtcttttcccgtgcgccttcctcttctgtgca

SEQ ID NO: 231846 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcagtctccacggtaccgggattacgcgatccttc

SEQ ID NO: 231847 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggtcccccctaacgcgttagccttccggaatg

SEQ ID NO: 231848 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccaccccgatagtcatcttcactggacacccgtgtta

SEQ ID NO: 231849 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccctgatagtcatcttcactggacacccgtgtta

SEQ ID NO: 231850 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgattagtcatcttcactggacacccgtgtta

SEQ ID NO: 231851 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatctttcactggacacccgtgtta

SEQ ID NO: 231852 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgacagtcatcttcactggaccacccgtgtta

SEQ ID NO: 231853 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattcgccagccacatcaactatgatgacgcttgactgga

SEQ ID NO: 231854 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cataaacaacatgatggaaatgctagccttctccatgccg

SEQ ID NO: 231855 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtactgcgcatgc

SEQ ID NO: 231856 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtcggtattgcgcatgc

SEQ ID NO: 231857 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcaacgagcggctaaggcc

SEQ ID NO: 231858 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgtcgtcaacaagcggctaaggcc

SEQ ID NO: 231859 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atttggcgccgaatcacgcctaggttctctcgttacgctg

SEQ ID NO: 231860 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggggcttttaagcacttctcggtaacttgggcagttac

SEQ ID NO: 231861 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atctggcgcctccacttccctagctagctaccatcgtttg

SEQ ID NO: 231862 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaccgcctcgattactccggtaccgttatgcataa

SEQ ID NO: 231863 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgccttgatcctcgcataatatgatacgtctg

SEQ ID NO: 231864 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcataatgtgatacgtctg

SEQ ID NO: 231865 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atatagctggcgtatttgcctcgatcctctattgtctgtg

SEQ ID NO: 231866 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agactattattgtgattcgccttgctccttccgtgtgctg

SEQ ID NO: 231867 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgccttgtaccacatatagcgctataggatcctacgtaa

SEQ ID NO: 231868 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagccatcgtttaaccgtttgttgcaa

SEQ ID NO: 231869 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatccggggcccgcctcaagctagctacctccattgtctg

SEQ ID NO: 231870 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatccgggccgcctcaagctagctacctccattgtcctga

SEQ ID NO: 231871 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcagcagttaatctgccctctgatgaaaccggttactt

SEQ ID NO: 231872 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtgattctgcccctctgatgaaaccggttactt

SEQ ID NO: 231873 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgtaccccagtttagtccttcctaaagggccctttga

SEQ ID NO: 231874 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaagtctagctacctccattgtcgtg

SEQ ID NO: 231875 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaatttacccatgggatttctgcctgtgtcttccccaaga

SEQ ID NO: 231876 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggtcccgcctcaagctagctacctccattgtctg

SEQ ID NO: 231877 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccgcctcaagctagctacctccacttgtctg

SEQ ID NO: 231878 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccctcctcaagctagctacctccattgtctg

SEQ ID NO: 231879 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcatgctagctacctccattgtctg

SEQ ID NO: 231880 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctaccttccattgctg

SEQ ID NO: 231881 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccattgtctc

SEQ ID NO: 231882 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctaactccattgtctg

SEQ ID NO: 231883 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagcgagctacctccattgtctg

SEQ ID NO: 231884 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgctcaagcctagctacctccacttgtctg

SEQ ID NO: 231885 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttgggaagcggaactggtcgaggcgctatcctcgactta

SEQ ID NO: 231886 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttaaggcgctaaccagctaatagcatggccccttaactg

SEQ ID NO: 231887 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttatccctgatgatctgaattctcatcggctggcactatc

SEQ ID NO: 231888 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggttgcctggtccgcctcgatcctctataccgtctg

SEQ ID NO: 231889 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcctcgatcctctataccgcctg

SEQ ID NO: 231890 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggtaccacgcctcggttcctcaaactttactaggcctag

SEQ ID NO: 231891 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgggatatgcgtgtttcctccaagcaccgcctcgctaacg

SEQ ID NO: 231892 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgctggaccggtaacaccgcctcagtcatctctctgccgg

SEQ ID NO: 231893 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgctatccgcatcgagcgggttcttcgataatatgcaaca

SEQ ID NO: 231894 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgctattttctgggaagccgcatctcgagcgaa

SEQ ID NO: 231895 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgattcactcctacggtgtgtctataga

SEQ ID NO: 231896 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctggggagccgcgtctcgagcgaa

SEQ ID NO: 231897 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatttcgagcgaa

SEQ ID NO: 231898 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatctcgagtgaa

SEQ ID NO: 231899 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttccgggaagccgcatctcgagcgaa

SEQ ID NO: 231900 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgccattttctgggaagccgcatctcgagcgaa

SEQ ID NO: 231901 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcactcggctgccccgcctctagttctctctcgtttggc

SEQ ID NO: 231902 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatggcttttaagcacttctcggtaacttgggcagttac

SEQ ID NO: 231903 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagactactactgatcacgccg

SEQ ID NO: 231904 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctttctcggtccatcagtctcgcatgcgctcctcctaca

SEQ ID NO: 231905 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgattaacatgaa

SEQ ID NO: 231906 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacaattaacataaa

SEQ ID NO: 231907 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcggtcgtgtcgtggactaccacagaagaatcgactgtcg

SEQ ID NO: 231908 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcctcgaacactgacgtcgtggaaccttcgattgctag

SEQ ID NO: 231909 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcaccccgatagtcatcttcactggaccacccgtgtta

SEQ ID NO: 231910 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcaaccacgctcataa

SEQ ID NO: 231911 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtcttcgatcgaccacgctcataa

SEQ ID NO: 231912 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgatgggctttaagcacttctcggtaacttggcagttac

SEQ ID NO: 231913 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgaacgccttgatccacccagatttcgttatggccaa

SEQ ID NO: 231914 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcaggccgctcttagccgcctctactagcttggagattag

SEQ ID NO: 231915 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgctagccacatcaactatgatgacgcttgactgga

SEQ ID NO: 231916 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccggtcacatcaactatgatgacgcttgactgga

SEQ ID NO: 231917 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccggccacatcaactatgatgacgcttgactgga

SEQ ID NO: 231918 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatggtgacgcttggctgga

SEQ ID NO: 231919 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttgactgaa

SEQ ID NO: 231920 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactataatgacgcttgactgga

SEQ ID NO: 231921 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacgtcaactatgatgacgcttgactgga

SEQ ID NO: 231922 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgacgcttgactaga

SEQ ID NO: 231923 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgacgacgcttgactgga

SEQ ID NO: 231924 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacaccaactatgatgacgcttgactgga

SEQ ID NO: 231925 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagcacatcaactatgatgacgcttggactgga

SEQ ID NO: 231926 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcaccagtcacatcaactatgatgacgcttgactgga

SEQ ID NO: 231927 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcaccagccacatcaactatgatgacgcttgactgga

SEQ ID NO: 231928 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcgcttctcgtaacttgggcagttac

SEQ ID NO: 231929 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcactttcggtaacttgggcagttac

SEQ ID NO: 231930 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaacttgggcgttac

SEQ ID NO: 231931 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcgatacttgggcagttac

SEQ ID NO: 231932 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttcgtcgtacttgggcagttac

SEQ ID NO: 231933 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttatagacttctcggtaacttgggcagttac

SEQ ID NO: 231934 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcgcttctcggtaacttgggcagttac

SEQ ID NO: 231935 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttcttggtaacttgggcagttac

SEQ ID NO: 231936 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttgggcagtcac

SEQ ID NO: 231937 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcagtaacttgggcagttac

SEQ ID NO: 231938 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacctctcggtaacttgggcagttac

SEQ ID NO: 231939 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacttgagcagttac

SEQ ID NO: 231940 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttcaagcacttctcggtaacttgggcagttac

SEQ ID NO: 231941 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagccacttctcggtaacttgggcagttac

SEQ ID NO: 231942 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcactttctcggataacttggcagttac

SEQ ID NO: 231943 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaactttgggcagttac

SEQ ID NO: 231944 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttgggcaagttac

SEQ ID NO: 231945 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctccggtaacttgggcagttac

SEQ ID NO: 231946 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcaccttctcggtaaacttggcagttac

SEQ ID NO: 231947 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaaagcactttctcgggtaacttggcagtac

SEQ ID NO: 231948 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcttactggggaagttgtatgtcccttttaacgtaacg

SEQ ID NO: 231949 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatccgccagtcacatcaactatgatgacgcttggctgga

SEQ ID NO: 231950 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatatgcatgcacacgttccgccttgcgccttccggtctg

SEQ ID NO: 231951 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatacgccagtcacatcaactatgatgacgcttgactgga

SEQ ID NO: 231952 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagagtgctcgtgagc

SEQ ID NO: 231953 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagaatgctcatgagc

SEQ ID NO: 231954 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcccgtcttttaatctcggcagagtgctcatgagc

SEQ ID NO: 231955 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgccagtcacatcaactatgatgacgcttgactgga

SEQ ID NO: 231956 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgatccgtactttcaggcgctatcctgatcacccaa

SEQ ID NO: 231957 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagccgctcatcatcggacacgacgtgtatcagttggctg

SEQ ID NO: 231958 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactgcctcatcatcggacacgacgtgtatcagttggctg

SEQ ID NO: 231959 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactcgccagtcacatcaactatgatgacgcttggctgga

SEQ ID NO: 231960 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtagatccgtcactcactacgcgtatggaatc

SEQ ID NO: 231961 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgccttgatccaacaggcctgtgtaaaccttcggctt

SEQ ID NO: 231962 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctgggctccttcccgaacagcatgctacatgagt

SEQ ID NO: 231963 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcattatcggacacgacgtgtatcagttggctg

SEQ ID NO: 231964 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacatcgacgtgtatcagttgctg

SEQ ID NO: 231965 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgatgtgtatcagttggctg

SEQ ID NO: 231966 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatcagttgtctg

SEQ ID NO: 231967 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatcagttggcgg

SEQ ID NO: 231968 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatcagtaggctg

SEQ ID NO: 231969 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggtccgaaccggtatgcatg

SEQ ID NO: 231970 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgccctcatggttcgaaccggtatgcatg

SEQ ID NO: 231971 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctatcctcatggttcgaaccggtatgcatg

SEQ ID NO: 231972 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctccgtcctcatggttcgaaccggtatgcatg

SEQ ID NO: 231973 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttcggaacgcctcgatcctcgcataatatgatacgtctg

SEQ ID NO: 231974 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtggtggttttctcggatttcctccctgccacccgtgatg

SEQ ID NO: 231975 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtctggaacgcctcgatcctcgcataatatgatacgtctg

SEQ ID NO: 231976 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcggaacgcctcgatcctcgcataatatcgatacgtctg

SEQ ID NO: 231977 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcctcgcctctgtcctcatggttcgaaccggtatgcatg

SEQ ID NO: 231978 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggagcgcctcgatcctcgcataatgtgatacgtctg

SEQ ID NO: 231979 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgtctcgatcctcgcataatatgatacgtctg

SEQ ID NO: 231980 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcatattatgatacgtctg

SEQ ID NO: 231981 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatattatacgtctg

SEQ ID NO: 231982 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgattcgtctg

SEQ ID NO: 231983 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgaataatatgatacgtctg

SEQ ID NO: 231984 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatccacgcataatatgatacgtctg

SEQ ID NO: 231985 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgcctcgatcctcgcataatatcgatacgtctg

SEQ ID NO: 231986 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaaacgcctcgatcctcgcataatatgatacgtctg

SEQ ID NO: 231987 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtccgcctcgattccgcccatacatgcatgtaa

SEQ ID NO: 231988 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcttcgattccgcccatacatgcatgtaa

SEQ ID NO: 231989 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattcctcccatacatgcatgtaa

SEQ ID NO: 231990 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgtccatacatgcatgtaa

SEQ ID NO: 231991 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgccatacatgcattgtaa

SEQ ID NO: 231992 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgaccatacatgcatgtaa

SEQ ID NO: 231993 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgacttccgccatacatgcatgtaa

SEQ ID NO: 231994 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatgcctcctcgcgcgctgatgttatgcataacctcgaa

SEQ ID NO: 231995 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatctttatccgcccctctgcatggtgggccctacatcg

SEQ ID NO: 231996 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatctttatccgccccctctgcatggtgggcctacatcg

SEQ ID NO: 231997 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggttactggtacgccttgatcttccacgtgcacgtaaatg

SEQ ID NO: 231998 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtgatcctcccccccgcctcgaagatttgtgcacacatc

SEQ ID NO: 231999 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtctcgggtctgcatttccgcctcgtcgatcccaggata

SEQ ID NO: 232000 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttcttctccttgactacatgagattaataaacgcgc

SEQ ID NO: 232001 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattaataaacgtgc

SEQ ID NO: 232002 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattaataaacacgc

SEQ ID NO: 232003 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacataagattaataaacgcgc

SEQ ID NO: 232004 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggattcttctcctgactacatgagattaataaacgcgc

SEQ ID NO: 232005 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcctcagtctcgtcttccccatcgtctgcatttgacggac

SEQ ID NO: 232006 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgtacttaccaccctgacatcgcggggaactaatggtt

SEQ ID NO: 232007 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgctgccttcattcgtctgatgatgtgcacctcgagt

SEQ ID NO: 232008 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccatcgcacataaacgtctcggtttggccatccgtggtt

SEQ ID NO: 232009 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcagtttcttctcctgactacatgagattaataaacgcgc

SEQ ID NO: 232010 - skipped

SEQ ID NO: 232011 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggcctttatacagacgca

SEQ ID NO: 232012 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgttcaaggcctttatacaaacgca

SEQ ID NO: 232013 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgttaaaggcctttatacaaacgca

SEQ ID NO: 232014 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgccgccctttgtttaaggcctttatacaaacgca

SEQ ID NO: 232015 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatgtttacagtgatcactttgctacctcgtcccgcta

SEQ ID NO: 232016 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctggcgtactacttgggcaggttccttc

SEQ ID NO: 232017 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctggcgtactacttggacgggttccttc

SEQ ID NO: 232018 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggacctggcgtactacttggacaggttccttc

SEQ ID NO: 232019 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gacgcgtaacgccttagtccccgtaaggatcctagttctg

SEQ ID NO: 232020 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaccggaacgcctcgatcctcgcataatatgatacgtctg

SEQ ID NO: 232021 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttagtgatttcgccgcccctctgtttagtggccactgga

SEQ ID NO: 232022 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcgctccctgtcattcgggcgctatcccgataatacga

SEQ ID NO: 232023 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcgagacgtctttcgtgcactatcacgatt

SEQ ID NO: 232024 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcatgcactatcacgatt

SEQ ID NO: 232025 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtcattcgtgcactatcacgatt

SEQ ID NO: 232026 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttacgtccgaggacgtctttcgtgcactatcacgatt

SEQ ID NO: 232027 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctaacccgggagtcgcctcgattgagacctctcctgtgca

SEQ ID NO: 232028 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgtttacatgtacccctaccatcgcacctattagcatatg

SEQ ID NO: 232029 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggctaacgctcatcgagggagcaaaaggtctatagacta

SEQ ID NO: 232030 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtatcgaggagtcttcttttctcactagaggc

SEQ ID NO: 232031 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtatcgagcgttgtcaacaagcggctaaggcc

SEQ ID NO: 232032 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcttggggcgttcttctctacatttcggtacg

SEQ ID NO: 232033 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgaacagtatgccgttttcggtg

SEQ ID NO: 232034 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtgtctggttaagcaacga

SEQ ID NO: 232035 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtgtctggttaaacaacgg

SEQ ID NO: 232036 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtgtctggtcaaacaacga

SEQ ID NO: 232037 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgtccttcccgcattgccgcaattgccatacattaata

SEQ ID NO: 232038 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgcagcctcggtcctactcagcatggccatgccgttat

SEQ ID NO: 232039 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctttccgaccccgtctgttcgtgggctacctcgatcata

SEQ ID NO: 232040 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgattcctcctagcatgctacagtggcgatcatgacg

SEQ ID NO: 232041 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcgatcagctagtcgtgctttgtccgctatgacattca

SEQ ID NO: 232042 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttgaacctccaatgccgtacggttatgcgcatcta

SEQ ID NO: 232043 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctctgtttcatcccgaattttgctcggataagtctg

SEQ ID NO: 232044 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctctaaagcgctttaactactcataccgtacggtga

SEQ ID NO: 232045 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgctgtagctactctggtaccatggtttgcgcgt

SEQ ID NO: 232046 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgcgtcgtgtacacgaagacctccggagactttg

SEQ ID NO: 232047 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgagcactgacgtcgtggaaccttcgattgctag

SEQ ID NO: 232048 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactggcgtcgtggaaccttcgattgctag

SEQ ID NO: 232049 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgtggaaccttcggttgctag

SEQ ID NO: 232050 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgtggaaccttcaattgctag

SEQ ID NO: 232051 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgccgtggaaccttcgattgctag

SEQ ID NO: 232052 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaatcctaccgtagcgctacttttcacatgctcg

SEQ ID NO: 232053 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccccgaacactgacgtcgtggaaccttcgattgctag

SEQ ID NO: 232054 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcatcccgatagtcatcttcactggaccacccgtgtta

SEQ ID NO: 232055 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacctcgatagtcatcttcactggaccacccgtgtta

SEQ ID NO: 232056 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatctccactggaccacccgtgtta

SEQ ID NO: 232057 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgcggacgccttatcctccagcctaggctcgttttctg

SEQ ID NO: 232058 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccatgaactcctactcgctattcaagtttgcgcaataaat

SEQ ID NO: 232059 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattatccgtttgtccgtcctcttgtggtattgcgcatgc

SEQ ID NO: 232060 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catcgatacgtccaaacgagccttcgcggctggcgctatc

SEQ ID NO: 232061 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagttctccattgtcgcgtgccggcattctcgcatctaaa

SEQ ID NO: 232062 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagcgtatcatggtgggatcttagcacctccgacatataa

SEQ ID NO: 232063 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagatgcttaagctctttcgccttaggtcctcattgccgg

SEQ ID NO: 232064 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacttcaccccgagaagcttcttaagcacgtcgttttgcg

SEQ ID NO: 232065 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactattcgtttgtccgtcctcttgtggtattgcgcatgc

SEQ ID NO: 232066 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtctgtcctcttgtggtattgcgcatgc

SEQ ID NO: 232067 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgtgcatgc

SEQ ID NO: 232068 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcatga

SEQ ID NO: 232069 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtgttgcgcatgc

SEQ ID NO: 232070 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgcgcacgc

SEQ ID NO: 232071 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgcggtattgcgcatgc

SEQ ID NO: 232072 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcgtgtggtattgcgcatgc

SEQ ID NO: 232073 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttctgtccgtcctctgtggtattgcgcatgc

SEQ ID NO: 232074 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtcttgacgtgttcccttcggacatccatcaa

SEQ ID NO: 232075 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcgacaagcggctaaggcc

SEQ ID NO: 232076 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgctgtcaacaagcggctaaggcc

SEQ ID NO: 232077 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagacccgtcactcactacgcgtatggaatc

SEQ ID NO: 232078 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgatcttgtctctccctctcaggcaaccg

SEQ ID NO: 232079 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcgatcgagcgacgtgttggcgagttagcacg

SEQ ID NO: 232080 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcgagcgatcgtcgtgatactgcttccaa

SEQ ID NO: 232081 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcgagcgatcgtcgtagtactgcttccaa

SEQ ID NO: 232082 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atttgaagccgcaccagctaatagcatggccccttaactg

SEQ ID NO: 232083 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attcctacgtgatttgatctctcatgggctaccatgtttc

SEQ ID NO: 232084 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attccgcctcattggttgagctctacccggtttgcgcaaa

SEQ ID NO: 232085 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attagttccagcgacttcggtggtgtcctctccattacca

SEQ ID NO: 232086 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaatcccagcgacttcggtggtgtcctctccattacca

SEQ ID NO: 232087 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggttccatgagcttctggcactatccagttgacgctca

SEQ ID NO: 232088 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgtagcttctggcactatccagttgacgctca

SEQ ID NO: 232089 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactatccaagttgacgctca

SEQ ID NO: 232090 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggacactatccagttgacgctca

SEQ ID NO: 232091 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgacgcttctggcactatccagttgacgctca

SEQ ID NO: 232092 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccactgagcttctggcactatccagttgacgctca

SEQ ID NO: 232093 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgcgaaacgctatttctgggaagccgcatctcgagcgaa

SEQ ID NO: 232094 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgtcgggccccttttatgaaacttacataaaagcgcac

SEQ ID NO: 232095 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcggtccatgagccttcggcactatccagttgacgctca

SEQ ID NO: 232096 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atattctgcaggctccgccttgcttctcctggtgtctggc

SEQ ID NO: 232097 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atattcaggatctattcgccttaggtcagcccggttgcat

SEQ ID NO: 232098 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atatgagatcggaccgcctcgttcctttgaccgcagtctg

SEQ ID NO: 232099 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtaccggtgcccgcctcagtcggaacccgctattgtctg

SEQ ID NO: 232100 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agatgggagactttgttcgactacgatcattgacgtcact

SEQ ID NO: 232101 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgccttgaatctccttctcggtcacgtgacatctgctg

SEQ ID NO: 232102 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcctcaggttcccctaacgcgttagccttccggaatg

SEQ ID NO: 232103 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactggactctcagcgcgcgacccatctcctcagta

SEQ ID NO: 232104 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgtttgttgcag

SEQ ID NO: 232105 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acaccggggcccgcctcaagctagctacctccattgtctg

SEQ ID NO: 232106 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacatacgcctgggtcgctctttgttctg

SEQ ID NO: 232107 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatctggagatcactaggcactatcctagcactgtatcaa

SEQ ID NO: 232108 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatccgggaccgcctcaagctagctacctccattgtcctg

SEQ ID NO: 232109 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacggtaattctgcccctctgatgaaaccggttactt

SEQ ID NO: 232110 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattctgcccctctgatgaaaccggttgctt

SEQ ID NO: 232111 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacaataattctgcccctctgatgaaaccggttactt

SEQ ID NO: 232112 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgcctcatcatcggacacgacgtgtatcagttggctg

SEQ ID NO: 232113 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacccggggcccgcctcaagctagctacctccattgtctg

SEQ ID NO: 232114 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaatccgggcccgcctcaagctagctacctccattgcctg

SEQ ID NO: 232115 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggggcccgcctcaagctagctacctccatgtctg

SEQ ID NO: 232116 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccgcctcaagtctagctacctccattgtctg

SEQ ID NO: 232117 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccgcctcaagctagctacctccattgtcgtg

SEQ ID NO: 232118 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaatctagctacctccattgtctg

SEQ ID NO: 232119 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagcttgctacctccattgtctg

SEQ ID NO: 232120 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagcttacctccatgtctg

SEQ ID NO: 232121 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctagctccattgtctg

SEQ ID NO: 232122 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctcgattgtctg

SEQ ID NO: 232123 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccattgtcgg

SEQ ID NO: 232124 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccattgactg

SEQ ID NO: 232125 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccaatgtctg

SEQ ID NO: 232126 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacatccattgtctg

SEQ ID NO: 232127 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcccacagctagctacctccattgtctg

SEQ ID NO: 232128 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctagctacctcccattgtctg

SEQ ID NO: 232129 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctagctacctccattgtctgc

SEQ ID NO: 232130 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctagctacctccattgtctga

SEQ ID NO: 232131 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaaccggggccgcctcaagctagctacctccattgtctg

SEQ ID NO: 232132 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttattctcctaaagccgcctcgcggacgtgtacacgaac

SEQ ID NO: 232133 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttaaggcgctaccagctaatagcattggccccttaactg

SEQ ID NO: 232134 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttaagcgcaccagctaatagcatggcccccccttaactg

SEQ ID NO: 232135 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttaagcctgtcttttaatctcggcagagtgctcatgagc

SEQ ID NO: 232136 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgtaccccgggttgcaattgcctcgtgaccagaccgcat

SEQ ID NO: 232137 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgtaccccgggttgcaattgcctcgtaaccaggccgcat

SEQ ID NO: 232138 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgtaccccgggctgcaattgcctcgtaaccagaccgcat

SEQ ID NO: 232139 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgggagctttaagcacttctcggtaacttgggcagttac

SEQ ID NO: 232140 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgcacagctcacttcgtctttgatcgaccacgctcataa

SEQ ID NO: 232141 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgactaccttccgctgcgtgtactcgtcctttttgtctg

SEQ ID NO: 232142 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcgcgaacgcctcagtcacccttctcggataacatgatt

SEQ ID NO: 232143 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcagcatcagctttcgggcgctatcccgatccagctgca

SEQ ID NO: 232144 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttatgggctttaagcacttctcggtaacttgggcagttac

SEQ ID NO: 232145 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgaaacgctattttctgggaagccgcatctcgagcgaa

SEQ ID NO: 232146 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcctcgatcccctataccgtctg

SEQ ID NO: 232147 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggcccgcctcgatcctctataccgtctg

SEQ ID NO: 232148 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtagatcgttcttatccgcctcggtcttccccaggttga

SEQ ID NO: 232149 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtagatcgttcttatccgcctcggtcctccccaggttaa

SEQ ID NO: 232150 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtacgcctgggtaccttcctaacggatcctttttgtctg

SEQ ID NO: 232151 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaagcctgtcttttaatctcggcagagtgctcatgagc

SEQ ID NO: 232152 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggcctcataagattcgaccttgctgcactatcagcttta

SEQ ID NO: 232153 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggactacccccgggtaagtcgtctttgagacatgtgctg

SEQ ID NO: 232154 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgctatccgccatcgagcgaacagtgtgccgttttcggtg

SEQ ID NO: 232155 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgattcactcctgcagtgtgtctataga

SEQ ID NO: 232156 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgattcactcctacagtgtgtctgtaga

SEQ ID NO: 232157 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgattcactcctacagtgtgtctatgga

SEQ ID NO: 232158 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgattcactcctacagtgcgtctataga

SEQ ID NO: 232159 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaatgctattttctgggaagccgcatctcgagcgaa

SEQ ID NO: 232160 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctgttttctgggaagccgcatctcgagcgaa

SEQ ID NO: 232161 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagctgcatctcgagcgaa

SEQ ID NO: 232162 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgtatctcgagcgaa

SEQ ID NO: 232163 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatctcggacgaa

SEQ ID NO: 232164 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatctcgatcgaa

SEQ ID NO: 232165 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatctagagcgaa

SEQ ID NO: 232166 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcaactcgagcgaa

SEQ ID NO: 232167 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctggaaagccgcatctcgagcgaa

SEQ ID NO: 232168 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgagaagccgcatctcgagcgaa

SEQ ID NO: 232169 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttctgggaagccgcatcctcgagcgaa

SEQ ID NO: 232170 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattgtctgggaagccgcatctcgagcgaa

SEQ ID NO: 232171 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatcttctgggaagccgcatctcgagcgaa

SEQ ID NO: 232172 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacactattttctgggaagccgcgtctcgagcgaa

SEQ ID NO: 232173 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaaacgcctcgatcctcgcataatatgatacgtctg

SEQ ID NO: 232174 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcaggtcgcctggtccgcctcgatcctctataccgtctg

SEQ ID NO: 232175 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcagacctcgcctctcattatctcggaccgtttctgcac

SEQ ID NO: 232176 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgactttatccgacggatctcacgtcccccttggttcggg

SEQ ID NO: 232177 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagactactactggtcacgtcg

SEQ ID NO: 232178 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagactactactgatcgcgtcg

SEQ ID NO: 232179 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagactactactgatcacgtca

SEQ ID NO: 232180 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggttcactagatctactactgatcacgtcg

SEQ ID NO: 232181 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtctcactagactactactgatcacgtcg

SEQ ID NO: 232182 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggcttcactagactactactgatcacgtcg

SEQ ID NO: 232183 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcgatttcactagactactactgatcacgtcg

SEQ ID NO: 232184 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctttcatctggtcgcgatacagaatacgattaacataaa

SEQ ID NO: 232185 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttcgccagtcacatcaactatgatgacgcttgactgga

SEQ ID NO: 232186 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcggtacagaatacgattaacataaa

SEQ ID NO: 232187 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagagtacgattaacataaa

SEQ ID NO: 232188 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgattgacataaa

SEQ ID NO: 232189 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctcggattatcatggtacatcttcttccccgaaacgcgc

SEQ ID NO: 232190 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctcacagctcacttcgtctttgatcgaccacgctcataa

SEQ ID NO: 232191 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgggatacttgaggtcgttgagcgcttacgaaccctaat

SEQ ID NO: 232192 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgctcagctcacttcgtctttgatcgaccacgctcataa

SEQ ID NO: 232193 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccgcgctcataa

SEQ ID NO: 232194 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccacgctcatga

SEQ ID NO: 232195 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccacgatcataa

SEQ ID NO: 232196 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgacaacgctcataa

SEQ ID NO: 232197 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgatgggctttagcacttctcggtaacttgggcagttac

SEQ ID NO: 232198 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgaatgggctttagcacttctcggtaacttggcagttac

SEQ ID NO: 232199 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcctctatagtcgtcggcgtagcacgctattgcttagaag

SEQ ID NO: 232200 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccctatcttgacgtctcttcggggactaccccgattctg

SEQ ID NO: 232201 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatggggctttaagcacttctcgtaacttgggcagttac

SEQ ID NO: 232202 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgacgtcggttcgcctcgggtccatcccaattgtctg

SEQ ID NO: 232203 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcagcctctgtcctgacatgtcaattggatatactgcaaa

SEQ ID NO: 232204 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcagcacacgctaatttcgtactgatcgcccctctgtgca

SEQ ID NO: 232205 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcaccgcctcatcatcggacacgacgtgtatcagttgctg

SEQ ID NO: 232206 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcaaaatcaggttcacgtgaatggcaaacagctgggtaag

SEQ ID NO: 232207 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatttgccagccacatcaactatgatgacgcttgactgga

SEQ ID NO: 232208 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattgcgcagtcacatcaactatgatgacgcttgactgga

SEQ ID NO: 232209 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgtcagtcacatcaactatgatgacgcttgactgga

SEQ ID NO: 232210 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacattaactatgatgacgcttgactgga

SEQ ID NO: 232211 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcgactatgatgacgcttgactgga

SEQ ID NO: 232212 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgtttgactgga

SEQ ID NO: 232213 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttgactaga

SEQ ID NO: 232214 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttgacagga

SEQ ID NO: 232215 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgactgacgcttgactga

SEQ ID NO: 232216 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgttgacgcttgactgga

SEQ ID NO: 232217 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgacgcctgactgga

SEQ ID NO: 232218 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactataatgacgcttgactgga

SEQ ID NO: 232219 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaacgatgatgacgcttgactgga

SEQ ID NO: 232220 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagcacatcaactatgactgacgcttgactgga

SEQ ID NO: 232221 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgacagtcacatcaactatgatgacgcttgactgga

SEQ ID NO: 232222 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgtacgtcctataccgcctcgatcagcgctttcgtcat

SEQ ID NO: 232223 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggggcttttaagcacttccgtgacttgggcagttac

SEQ ID NO: 232224 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagctactctcgatacttgggcagttac

SEQ ID NO: 232225 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctggtaacttgagcagttac

SEQ ID NO: 232226 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttagtcacttctcggtaacttgggcagttac

SEQ ID NO: 232227 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttacagacttctcggtaacttgggcagttac

SEQ ID NO: 232228 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtgacttgggcagttac

SEQ ID NO: 232229 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttgggtagttac

SEQ ID NO: 232230 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttgggcagctac

SEQ ID NO: 232231 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttaggcagttac

SEQ ID NO: 232232 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaactcgggcagttac

SEQ ID NO: 232233 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacctgggcagttac

SEQ ID NO: 232234 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggcaacttgggcagttac

SEQ ID NO: 232235 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttctaagcacttctggtaacttgggcagttac

SEQ ID NO: 232236 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttcaagcacttctcggtaacttgggcagttac

SEQ ID NO: 232237 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttgagcacttctcggtaacttgggcagttac

SEQ ID NO: 232238 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcgacttctcggtaacttggcagttac

SEQ ID NO: 232239 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcgttaacttgggcagttac

SEQ ID NO: 232240 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggttacttgggcagttac

SEQ ID NO: 232241 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggcaacttgggcagttac

SEQ ID NO: 232242 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttagagcacttctcggtaacttgggcagttac

SEQ ID NO: 232243 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcggtaacttggcaagttac

SEQ ID NO: 232244 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcactttctcgggtaacttggcagttac

SEQ ID NO: 232245 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcgtaacttgggcagttaccc

SEQ ID NO: 232246 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttgggtcagttac

SEQ ID NO: 232247 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttgggcgagttac

SEQ ID NO: 232248 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttgggacagttac

SEQ ID NO: 232249 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttcgggcagttac

SEQ ID NO: 232250 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcgggtaacattggcagttac

SEQ ID NO: 232251 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttcctcggtaacttgggcagttac

SEQ ID NO: 232252 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcaccttctcggtaacttgggcagttac

SEQ ID NO: 232253 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaacgcacttctcggtacttgggccagttac

SEQ ID NO: 232254 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaacgcacttctcggtaacttgggcagttac

SEQ ID NO: 232255 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaaagcactttctcgggtaactggcagttac

SEQ ID NO: 232256 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctcttaagcacttctcggtaacttgggcagttac

SEQ ID NO: 232257 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcgtttaaagcactttctgggatacctggcagtac

SEQ ID NO: 232258 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggccttttaagcacttctcggtaacttggcagttac

SEQ ID NO: 232259 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgcttactgggaagttgtatgtcccttttaacgtaacg

SEQ ID NO: 232260 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgaggctttaagcacttctcggtaacttgggcagttac

SEQ ID NO: 232261 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgaagcctgtctttaatctcggcagagtgctcatgagc

SEQ ID NO: 232262 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcttactgggaagttgtatgtccccttttaacgtaacg

SEQ ID NO: 232263 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgcctagtcacatcaactatgatgacgcttgactgga

SEQ ID NO: 232264 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttgatctcggcagagtgctcatgagc

SEQ ID NO: 232265 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagagtactcatgagc

SEQ ID NO: 232266 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagagcgctcatgagc

SEQ ID NO: 232267 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcaaagtgctcatgagc

SEQ ID NO: 232268 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatcccggcagagtgctcatgagc

SEQ ID NO: 232269 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtctttaatctcggcagtagtgctcatgagc

SEQ ID NO: 232270 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtctttaatctcggcagagtcgctcatgagc

SEQ ID NO: 232271 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagccctgtcttttaatctcgcagagtgctcatgagc

SEQ ID NO: 232272 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgatccgtactttcgggcgctatcctgatcacccga

SEQ ID NO: 232273 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagggtatccatgaaggactaccttcttactggagacttg

SEQ ID NO: 232274 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taggcgcttttaagcacttctcggtaacttgggcagttac

SEQ ID NO: 232275 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatgatcctccgggccgcgtcgaatcctaatagtctg

SEQ ID NO: 232276 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgcttgtccgtcctcttgtggtattgcgcatgc

SEQ ID NO: 232277 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacgttgaatgttatccgccttgcttccgtccctaagctg

SEQ ID NO: 232278 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacgcgtacgccttgtccccagcctaggctaaatacacgt

SEQ ID NO: 232279 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacgaaacgctattttctgggaagccgcgtctcgagcgaa

SEQ ID NO: 232280 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacctccaccgcctcgtaagcccgggcacttacctctgta

SEQ ID NO: 232281 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccggcactggaggcgtccttggtggactaccaccttgt

SEQ ID NO: 232282 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccggcaccggaggcgtccttggtggactaccaccttat

SEQ ID NO: 232283 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatctatcggacacgacgtgtatcagttgctg

SEQ ID NO: 232284 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggtcacgacgtgtatcagttggctg

SEQ ID NO: 232285 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggatacgacgtgtatcagttggctg

SEQ ID NO: 232286 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgtacgtgtatcagttgctg

SEQ ID NO: 232287 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatgagttggctg

SEQ ID NO: 232288 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatcagttggcag

SEQ ID NO: 232289 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatcagttgcgtg

SEQ ID NO: 232290 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcactcatcggacacgacgtgtatcagttgctg

SEQ ID NO: 232291 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcaacatcggacacgacgtgtatcagttggctg

SEQ ID NO: 232292 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctaatcatcggacacgacgtgtatcagttggctg

SEQ ID NO: 232293 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacccgcctcgaaagcatgctgttatctcggatgtgtaca

SEQ ID NO: 232294 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccacctcatcatcggacacgacgtgtatcagttggctg

SEQ ID NO: 232295 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taataggccgggtcccgcggactaccgcggttttatgcgt

SEQ ID NO: 232296 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taagagtgcacggtactgcctcgatcctccatggcttaag

SEQ ID NO: 232297 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttgtatgcaaacttacaccccgattgctctgagctcctg

SEQ ID NO: 232298 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcttctgtcctcatggttcgaaccggtatgcatg

SEQ ID NO: 232299 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgccttctgtcctcatgttcgaaccggtatgcatg

SEQ ID NO: 232300 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctccatgttcgaaccggtatgcatg

SEQ ID NO: 232301 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggttcgaatcggtatgcatg

SEQ ID NO: 232302 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggttcgaaccgatatgcatg

SEQ ID NO: 232303 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggtgcgaaccggtatgcatg

SEQ ID NO: 232304 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggtacgaaccggtatgcatg

SEQ ID NO: 232305 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttcccgcctctgtcctcatggttcgaaccggtatgcatg

SEQ ID NO: 232306 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttcatggtacgcctcgattccgcccatacatgcatgtaa

SEQ ID NO: 232307 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtggtttcttctcctgactacatgagattaataaacgcgc

SEQ ID NO: 232308 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgatcatataaagccggcttgctcgcctcggtcctccat

SEQ ID NO: 232309 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtctcgggtccgttgtttaccgcttcgctccggcccagta

SEQ ID NO: 232310 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacatcgcggggaactagtggtt

SEQ ID NO: 232311 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgcatgggtcggttttggtgggggactacccccttgta

SEQ ID NO: 232312 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcctgaacgcctcgatcctcgcataatatgatacgtctg

SEQ ID NO: 232313 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgttctcgtataattcaggatggcttattatctagct

SEQ ID NO: 232314 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgattcctcgcatatatgatacgtctg

SEQ ID NO: 232315 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatctgatacgtctg

SEQ ID NO: 232316 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgatacttctg

SEQ ID NO: 232317 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgatacctctg

SEQ ID NO: 232318 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataataagatacgtctg

SEQ ID NO: 232319 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcaaaatatgatacgtctg

SEQ ID NO: 232320 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcccataatatgatacgtctg

SEQ ID NO: 232321 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctagcataatatgatacgtctg

SEQ ID NO: 232322 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgccctgatcctcgcataatatgatacgtctg

SEQ ID NO: 232323 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaaagcctcgatcctcgcataatatgatacgtctg

SEQ ID NO: 232324 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgagacgcctcgatcctcgcataatatgatacgtctg

SEQ ID NO: 232325 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatgtacgcctcgattccgcccatacaatgcatgtaa

SEQ ID NO: 232326 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatagatgcatgtaa

SEQ ID NO: 232327 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatgtatgtaa

SEQ ID NO: 232328 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatgcatgtac

SEQ ID NO: 232329 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatgcatggaa

SEQ ID NO: 232330 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatgcatataa

SEQ ID NO: 232331 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccacgcatgcatgtaa

SEQ ID NO: 232332 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccaaacatgcatgtaa

SEQ ID NO: 232333 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgccatcacatgcatgtaa

SEQ ID NO: 232334 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgccatacatgacatgtaa

SEQ ID NO: 232335 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctccgattccgccatacatgcatgtaa

SEQ ID NO: 232336 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatgggacgcctcgattccgcccatacatgcatgtaa

SEQ ID NO: 232337 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggaacgcctcgattccgcccatacatgcatgtaa

SEQ ID NO: 232338 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatgatacgcctcgattccgcccatacatgcatgtaa

SEQ ID NO: 232339 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcaatgtccttcatgcatcacgcatcccctcgcaggatt

SEQ ID NO: 232340 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcaatggtacgcctcgattccgcccatacatgcatgtaa

SEQ ID NO: 232341 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatgggctttaagctacttctcggtaacttggcagttac

SEQ ID NO: 232342 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaggtgcgtaccctctttagccgcctctgaagattgaat

SEQ ID NO: 232343 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaataacctcccgttactcgcctcgggcaagtgtgcgca

SEQ ID NO: 232344 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtgatcctccccccccgctcgaagatttgtgcacatatc

SEQ ID NO: 232345 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtccctgtgtcttattgccacagacgttcagtgcccccg

SEQ ID NO: 232346 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcgaaacgctattttctgggaagccgcatctcgagcgaa

SEQ ID NO: 232347 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggccttctttaccttttgagcgctatctcaatctctggta

SEQ ID NO: 232348 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggccatggtacgcctcgattccgcccatacatgcatgtaa

SEQ ID NO: 232349 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggacatgtgttggtcatccaagactacttggttcacggcc

SEQ ID NO: 232350 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctgacgtttcacgcacgcggattgtacccgaactgggtt

SEQ ID NO: 232351 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggcttttacgcacgcggattgtacccgaactgggtt

SEQ ID NO: 232352 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtactcgaactgggtt

SEQ ID NO: 232353 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtacccgaactgggct

SEQ ID NO: 232354 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggactgtacccgagctgggtt

SEQ ID NO: 232355 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggccttcacgcacgcggattgtacccgaactgggtt

SEQ ID NO: 232356 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccttcgtccagcggagtcatccggtggccttaagca

SEQ ID NO: 232357 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttcttctcctgactacattgagattaataaacgcgc

SEQ ID NO: 232358 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtgatcagctagtcgtgctttgtccgctatgacattca

SEQ ID NO: 232359 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacgtgagattaataaacgcgc

SEQ ID NO: 232360 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattgataaacgcgc

SEQ ID NO: 232361 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattagtaaacgcgc

SEQ ID NO: 232362 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattaataagcgcgc

SEQ ID NO: 232363 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattaataaacgcgg

SEQ ID NO: 232364 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattaataaacgcac

SEQ ID NO: 232365 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattaacaaacgcgc

SEQ ID NO: 232366 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagactaataaacgcgc

SEQ ID NO: 232367 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacacgagattaataaacgcgc

SEQ ID NO: 232368 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgaccacatgagattaataaacgcgc

SEQ ID NO: 232369 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttctcctcctgactacatgagattaataaacgcgc

SEQ ID NO: 232370 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttcttctcctcgactacatgagattaataaacgcgc

SEQ ID NO: 232371 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgctatgctctgtgtagatcggactcctattaaggatc

SEQ ID NO: 232372 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccctatcttgacgtctcttcggggactaccccgattctg

SEQ ID NO: 232373 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccggcctctgtacctctctttgcacgtgcatgttgttg

SEQ ID NO: 232374 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgctgcctctattcgtctgatgatgtgcacctcgagt

SEQ ID NO: 232375 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgcctcatcatcggacacgacgtgtatcagttggctg

SEQ ID NO: 232376 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgcctcagtaatctcctaatggtccagtatgtacata

SEQ ID NO: 232377 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccacatgggtcggttttggtgggggactacccccttgta

SEQ ID NO: 232378 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcataggcttcacgcacgcggattgtaaccgaactgggtt

SEQ ID NO: 232379 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcagaataaattcctcccactgctcgcctcgcatgctgta

SEQ ID NO: 232380 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcactattccggccttcaccgtcctcgatacggacgaatg

SEQ ID NO: 232381 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcactattccggccttcaccgtcctcaatacggacgaatg

SEQ ID NO: 232382 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcggcgtcgagtaactctatactgcactatcagtttgt

SEQ ID NO: 232383 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcctactgccctccttacaacggttgttaatggacgca

SEQ ID NO: 232384 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatccggacgcctcgatcctcgcataatatgatacgtctg

SEQ ID NO: 232385 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatccggaacgcctcgatcctcgcatatatgatacgtctg

SEQ ID NO: 232386 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatccatggtacgcctcgattccgccatacatgcatgtaa

SEQ ID NO: 232387 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgcctttcgtttaaggcctttatacaaacgca

SEQ ID NO: 232388 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttgaggcctttatacaaacgca

SEQ ID NO: 232389 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggcctttatataaacgca

SEQ ID NO: 232390 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggcctttatacaaacgcg

SEQ ID NO: 232391 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggccttgatacaaacgca

SEQ ID NO: 232392 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggccttcatacaaacgca

SEQ ID NO: 232393 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggcatttatacaaacgca

SEQ ID NO: 232394 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaagacctttatacaaacgca

SEQ ID NO: 232395 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgttaaggtcctttatacaaacgca

SEQ ID NO: 232396 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtgtaaggcctttatacaaacgca

SEQ ID NO: 232397 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtctaaggcctttatacgaacgca

SEQ ID NO: 232398 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtctaaggcctttatacaaacgca

SEQ ID NO: 232399 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttcgttaaggcctttatacaaacgca

SEQ ID NO: 232400 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttatttaaggcctttatacaaacgca

SEQ ID NO: 232401 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgcccttcgtttaaggcctttatacaaacgca

SEQ ID NO: 232402 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccccttgtttaaggcctttatacaaacgca

SEQ ID NO: 232403 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatatctttatccgcccctctgcatggtgggcctacatcg

SEQ ID NO: 232404 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcgggtctggcgtactacttggacaggttccttc

SEQ ID NO: 232405 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctagcgtactacttggacaggttccttc

SEQ ID NO: 232406 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatcccggatctggcgtactacttggacaggttccttc

SEQ ID NO: 232407 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactaggcttcacgcacgcggattgtacccgaactgggtt

SEQ ID NO: 232408 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactactcgcatcgagcgttgtcaagctgagtgcaagtta

SEQ ID NO: 232409 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaccacgctgccctttgtttaaggcctttatacaaacgca

SEQ ID NO: 232410 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gacatgtacgccttggtcacttccaacaaacctaggttaa

SEQ ID NO: 232411 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaattagtactgacggccgccttgatcctccgctagtctg

SEQ ID NO: 232412 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaattagtactgacggccgccctgatcctccgttagtctg

SEQ ID NO: 232413 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggatcctcgcctccgtactacgtggatttagattt

SEQ ID NO: 232414 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggatcctcgcctccatactacgtggatttaggttt

SEQ ID NO: 232415 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccggggcccgcctcaagctagctacctctattgtctg

SEQ ID NO: 232416 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttggacgtccaactgctgcctcgactcctccatcggata

SEQ ID NO: 232417 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttagttgatttcgccgcccctctgtttagtggccattga

SEQ ID NO: 232418 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttagtgatttcgccgcccctctgtttagtggccattaga

SEQ ID NO: 232419 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcctcggtgatcctcaatcctcctggatatatatcata

SEQ ID NO: 232420 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctttatccggcaggactctttcgtgcactatcacgatt

SEQ ID NO: 232421 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttctccggcaggacgtctttcgtgcactatcacgatt

SEQ ID NO: 232422 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcaggacgtcttcgtgcactatcacgatt

SEQ ID NO: 232423 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcagacgtctttcgtgcactatcacgatt

SEQ ID NO: 232424 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccgggaggacgtctttcgtgcactatcacgatt

SEQ ID NO: 232425 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcatgacgtctttcgtgcactatcacgatt

SEQ ID NO: 232426 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggcagtctttcgtgcactatcacgatt

SEQ ID NO: 232427 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacttctttcgtgcactatcacgatt

SEQ ID NO: 232428 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtttttcgtgcactatcacgatt

SEQ ID NO: 232429 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactatctcgatt

SEQ ID NO: 232430 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcaatatcacgatt

SEQ ID NO: 232431 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtcttacgtgcactatcacgatt

SEQ ID NO: 232432 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctatcgtgcactatcacgatt

SEQ ID NO: 232433 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaagacgtctttcgtgcactatcacgatt

SEQ ID NO: 232434 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccgcaggacgtctttacgtgcactatcacgatt

SEQ ID NO: 232435 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttacgccgcaggacgtctttcgtgcactatcacgatt

SEQ ID NO: 232436 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttaccgccgaggacgtctttcgtgcactatcacgatt

SEQ ID NO: 232437 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctatccggcaggacgatctttcgtgcactatcacgatt

SEQ ID NO: 232438 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcgcaagccatgctctagacgcctcaaaaagatgatgct

SEQ ID NO: 232439 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcgagacgcctcagtacttccttgggcccaacaacagtt

SEQ ID NO: 232440 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcctttagtctttcgtctcgatgggcggtttttcgagtc

SEQ ID NO: 232441 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccttatccggcaggacgtctttcgtgcactatcacgat

SEQ ID NO: 232442 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccgtagatgcgcacttatgtgggctgcctgtgtcacac

SEQ ID NO: 232443 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctagcttcctcgaagtcttcctctgctgtatccggattgg

SEQ ID NO: 232444 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctacgaactagtggtctttgtgcgcttaagacccgtcgat

SEQ ID NO: 232445 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctaagcccggtttgcccgcctcagttctcctacggttatt

SEQ ID NO: 232446 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctaaaatcttcccgagccgcctcgaagactttgaaatgcg

SEQ ID NO: 232447 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgtagatcgttcttatccgcctcggtcttccccaggttaa

SEQ ID NO: 232448 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcttatccggcaggacgtctttcgtgcactatcacgatt

SEQ ID NO: 232449 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctctggctccgaatccacgttcggttctcacatcgctg

SEQ ID NO: 232450 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgagcgagcactctgtgcgatcacaca

SEQ ID NO: 232451 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagtcgaacagtgtgccgtttcggtg

SEQ ID NO: 232452 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgaacagtgtgccgtttccggtg

SEQ ID NO: 232453 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgaacagcgtgccgttttcggtg

SEQ ID NO: 232454 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagtcgggttctcgataatatgcaaca

SEQ ID NO: 232455 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggttcttcgataatgtgcaaca

SEQ ID NO: 232456 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggttcttcgataatatgtaaca

SEQ ID NO: 232457 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggttcctcgataatatgcaaca

SEQ ID NO: 232458 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtgtctggttagacaacga

SEQ ID NO: 232459 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtgtctggttaaacagcga

SEQ ID NO: 232460 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtgtctggctaaacaacga

SEQ ID NO: 232461 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcctgagtgtctggttaaacaacga

SEQ ID NO: 232462 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgtcttccccgcattgccgcaattgccacacattaata

SEQ ID NO: 232463 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccttgatcctcgctttcggtgcactgactcgccttctg

SEQ ID NO: 232464 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcctcacgtcatgacctcgccctctctctcgtatgtgca

SEQ ID NO: 232465 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccgtgatcctcggagtgaactcggattgtctgtgctac

SEQ ID NO: 232466 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccggaagtccctccccgtcttgatgcactatcatctca

SEQ ID NO: 232467 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgagaagtttagtgtttgtcacgcaccggccctggcactc

SEQ ID NO: 232468 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgaagtccgcggtttcactagactactactgatcacgtcg

SEQ ID NO: 232469 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccttccagggcccaatgccgcattatcaccctatgttctg

SEQ ID NO: 232470 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgatacctcgctttgcatgcaaaaaactacgtatggc

SEQ ID NO: 232471 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtggtcagctagtcgtgctttgtccgctatgacattca

SEQ ID NO: 232472 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgcgattcttaccaaactgccgcccctctgtgtgcac

SEQ ID NO: 232473 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcagctggtcgtgctttgtccgctatgacattca

SEQ ID NO: 232474 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgaccagctagtcgtgctttgtccgctatgacattca

SEQ ID NO: 232475 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtctcggattctatacatgtataaatctgtcctgccgg

SEQ ID NO: 232476 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtcgcgtacaaaaatcttgggacttcaatcgctggcta

SEQ ID NO: 232477 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtcgcgtacaaaaatcttgggacttcaatcgctgacta

SEQ ID NO: 232478 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtagccagcattcttaacttcctctgcatgatcatgta

SEQ ID NO: 232479 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgggcgttcctccggtaggcctacgtacgtgacggatta

SEQ ID NO: 232480 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttgtctccaaataagatgaacctaggtttatataa

SEQ ID NO: 232481 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttgctcctggttgacatgtcacatccacgtttggc

SEQ ID NO: 232482 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttgacccttcccacttgtgcacaacctcttggaaa

SEQ ID NO: 232483 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttgaacactgacgtcgtggaaccttcgattgctag

SEQ ID NO: 232484 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctctctaaccggtacggacactccctcgtttggcgc

SEQ ID NO: 232485 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgggtcgttcccaatggtggtacccctattaatg

SEQ ID NO: 232486 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcggatcgctcccaatggtggtacccctattaatg

SEQ ID NO: 232487 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcggacactgacgtcgtggaaccttcgattgctag

SEQ ID NO: 232488 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgatctgcagtccccgggtgcaccatgaagtttg

SEQ ID NO: 232489 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgatccttcgggttaggtacctatgcgtctgcgg

SEQ ID NO: 232490 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgacggttccctaacgcgttagccttccggaatg

SEQ ID NO: 232491 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgtggatccttcgattgctag

SEQ ID NO: 232492 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgtggagccttcgattgctag

SEQ ID NO: 232493 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgtggaaccttcgattgccag

SEQ ID NO: 232494 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgtggaaccttcgatcgctag

SEQ ID NO: 232495 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactaacgtcgtggaaccttcgattgctag

SEQ ID NO: 232496 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacaccgacgtcgtggaaccttcgattgctag

SEQ ID NO: 232497 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcagtccttctcggttcgttcatcccaacgttgtg

SEQ ID NO: 232498 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaactgcgttagccttccggaatg

SEQ ID NO: 232499 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgttgagccttccggaatg

SEQ ID NO: 232500 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgttagccttccgggaatg

SEQ ID NO: 232501 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgttagccttccggaatcg

SEQ ID NO: 232502 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttccccctaatgcgttagccttccggaatg

SEQ ID NO: 232503 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccacccgatagtcatcttcactggaccacccgtgtta

SEQ ID NO: 232504 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcactccgatagtcatcttcgctggaccacccgcgtta

SEQ ID NO: 232505 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatgatcatcttcactggaccacccgtgtta

SEQ ID NO: 232506 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcgtcttcactggaccacccgtgtta

SEQ ID NO: 232507 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggactacccgtgtta

SEQ ID NO: 232508 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggaccacccgtgcta

SEQ ID NO: 232509 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcctcactggaccacccgtgtta

SEQ ID NO: 232510 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcaatcttcactggacacccgtgtta

SEQ ID NO: 232511 - skipped

SEQ ID NO: 232512 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgcctttgtctccttgtgcacatgcgcgcagtacatta

SEQ ID NO: 232513 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgcctcgatattcgaatctagattagacttctcgtttg

SEQ ID NO: 232514 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccatttaaatggctgcccctctgtgttacggccttaaata

SEQ ID NO: 232515 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccagttcattgactactttgatgttatgtgctaagcatac

SEQ ID NO: 232516 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattgatactcctgttctcgcgtttgcctccctgtgcgca

SEQ ID NO: 232517 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattcaatctcgggtctgtgttcctcccgcatgcacgcgt

SEQ ID NO: 232518 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catggggcttttaagcacttctggtaacttgggcagttac

SEQ ID NO: 232519 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catggggctttaagcacttctcggtaacttgggcagttac

SEQ ID NO: 232520 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catcttccatccggccatggcatattagaatcgtaaggta

SEQ ID NO: 232521 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catcacagtaattctgcccctctgatgaaaccggttactt

SEQ ID NO: 232522 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cataagcctgtcttttaatctcggcagagtgctcatgagc

SEQ ID NO: 232523 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagtttcatgaatgcggcctcgagagactaaacgactgat

SEQ ID NO: 232524 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caggttcacaagtgaaaggctactttctcacgccggtgcg

SEQ ID NO: 232525 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caggtgtgtatatctcccgcctcgctccttaaggaactta

SEQ ID NO: 232526 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagactgtctttcgaatcgcgttgcctctgacactgtctg

SEQ ID NO: 232527 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacttatccggcaggacgtctttcgtgcactatcacgatt

SEQ ID NO: 232528 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatctgtttgtccgtcctcttgtggtattgcgcatgc

SEQ ID NO: 232529 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccttttgtccgtcctcttgtggtattgcgcatgc

SEQ ID NO: 232530 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtctgtcctctcgtggtattgcgcatgc

SEQ ID NO: 232531 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgttctcttgtggtattgcgcatgc

SEQ ID NO: 232532 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttttggtattgcgcatgc

SEQ ID NO: 232533 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgttgtattgcgcatgc

SEQ ID NO: 232534 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcttgc

SEQ ID NO: 232535 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcataa

SEQ ID NO: 232536 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcaggc

SEQ ID NO: 232537 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgaatgc

SEQ ID NO: 232538 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggaattgcgcatgc

SEQ ID NO: 232539 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctggtggtattgcgcatgc

SEQ ID NO: 232540 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcttggtattgcgcatgc

SEQ ID NO: 232541 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgcgtatgc

SEQ ID NO: 232542 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgcgcatac

SEQ ID NO: 232543 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtatcgcgcatgc

SEQ ID NO: 232544 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtgatattgcgcatgc

SEQ ID NO: 232545 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcccgtggtattgcgcatgc

SEQ ID NO: 232546 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccacttgtggtattgcgcatgc

SEQ ID NO: 232547 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccatcctcttgtggtattgcgcatgc

SEQ ID NO: 232548 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgcccgtcctctcgtggtattgcgcatgc

SEQ ID NO: 232549 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgaccgtcctcttgtggtattgcgcatgc

SEQ ID NO: 232550 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttctccgtcctcttgtggtattgcgcatgc

SEQ ID NO: 232551 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgatcctcttgtggtattgcgcatgc

SEQ ID NO: 232552 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtcttaacgtgttcccctcggacatccatcaa

SEQ ID NO: 232553 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtcctctcgtggtattgcgcatgc

SEQ ID NO: 232554 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcaataagcggctaaggcc

SEQ ID NO: 232555 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcaacaagcggctgaggcc

SEQ ID NO: 232556 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcaacaagcggctaaggct

SEQ ID NO: 232557 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcaacaagcagctaaggcc

SEQ ID NO: 232558 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcattgtcaacaagcggctaaggcc

SEQ ID NO: 232559 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcactacgcgtatagaatc

SEQ ID NO: 232560 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgatcactcactacgcgtatggaat

SEQ ID NO: 232561 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcatcgagcgttgtcaacaagcggctaaggcc

SEQ ID NO: 232562 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgacatcgagggagctacgtcatcaagcgctaa

SEQ ID NO: 232563 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcgagcgatcgtcgtaatactgctcccaa

SEQ ID NO: 232564 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccatttgtccgtcctcttgtggtattgcgcatgc

SEQ ID NO: 232565 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccgtgactacacggatttctgcccgaatcgacaattgt

SEQ ID NO: 232566 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgtttgtccgtcctctcgtggtattgcgcatgc

SEQ ID NO: 232567 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacaatactcccttgagccgcctcttgtcgacaggttgcg

SEQ ID NO: 232568 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caattctcgagtatgcctcctcgtattctcctattcgctg

SEQ ID NO: 232569 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgcttgatctcctgtcgactctggcgctgagactact

SEQ ID NO: 232570 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgcttgatcccctgtcgactctgcggctgagactact

SEQ ID NO: 232571 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attccccctgagtgttgagtcggtcaagcactatcttgaa

SEQ ID NO: 232572 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttcggtggtgtcctctccactacca

SEQ ID NO: 232573 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcaacttcggtggtgtcctctccattacca

SEQ ID NO: 232574 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaaacggattaaggccgcctctggttctcctggattgt

SEQ ID NO: 232575 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgagtcttctcggcactatccagttgacgctca

SEQ ID NO: 232576 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgaggcttcggcatctatccagttgacgctcta

SEQ ID NO: 232577 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgagcttctggacactatccagttgacgtctca

SEQ ID NO: 232578 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccactgagctctggacactatcagttgacgtgctca

SEQ ID NO: 232579 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtcccatgagcttctggcactatccagttgacgctca

SEQ ID NO: 232580 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcgactatccagttgacgctca

SEQ ID NO: 232581 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggccactatccagttgacgctca

SEQ ID NO: 232582 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactactccagttgacgctca

SEQ ID NO: 232583 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttcctggcactatccagttgacgctca

SEQ ID NO: 232584 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttactggcactatccagttgacgctca

SEQ ID NO: 232585 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggatccatgagcttctggcactatccagttgacgctca

SEQ ID NO: 232586 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggaggctttaagcacttctcggtaacttgggcagttac

SEQ ID NO: 232587 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgatggctttaagcacttctcggtaacttgggcagttac

SEQ ID NO: 232588 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgaactgtgaatcgtttacctctggactacccggggcaa

SEQ ID NO: 232589 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgtcgggccccttttatgaagcttacatgaaagcgcac

SEQ ID NO: 232590 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgtcgggccccttttatgaaatttacatgaaagcgcac

SEQ ID NO: 232591 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcggtccactgagcttcggcactatccagttgacgctca

SEQ ID NO: 232592 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgatgggctttaagcacttctcgtaacttggcagttac

SEQ ID NO: 232593 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcatgatatgatacgtctg

SEQ ID NO: 232594 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcataatatgatacatctg

SEQ ID NO: 232595 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcataatatgacacgtctg

SEQ ID NO: 232596 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattctgcccatacatgcatgtaa

SEQ ID NO: 232597 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgcccatacgtgcatgtaa

SEQ ID NO: 232598 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgcccatacatgcatgtag

SEQ ID NO: 232599 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgcccacacatgcatgtaa

SEQ ID NO: 232600 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgatcccgcccatacatgcatgtaa

SEQ ID NO: 232601 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggcacgcctcgattccgcccatacatgcatgtaa

SEQ ID NO: 232602 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcaattccagcgacttcggtggtgtcctctccattacca

SEQ ID NO: 232603 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atatgggctttaagcaccttctcggtaacttggcagttac

SEQ ID NO: 232604 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ataagggccctatttacgcctcgatggatgtgcagctgta

SEQ ID NO: 232605 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtgcctgaccgccttgatccttcctctcggaaacgcgta

SEQ ID NO: 232606 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtctgaccctgttatggactaccatatcagaaaggtgct

SEQ ID NO: 232607 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtctcggatcatatgtttcgtttccctgcctaggtaaca

SEQ ID NO: 232608 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtcattaatccttgttggactaccaccaaaaacgattaa

SEQ ID NO: 232609 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aggatatctaaccgcctcagttccggcatagtcttctgcg

SEQ ID NO: 232610 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agcggctcgatttgttctggtcctccttcgcgccgcaacg

SEQ ID NO: 232611 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agcgctatctccggagatatcgttattactacgcgaaagt

SEQ ID NO: 232612 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agcgcctgaccgccttgatccttcttctcggaaacgcgta

SEQ ID NO: 232613 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agattatgatatcactagacctaccgcctcgcagtacgta

SEQ ID NO: 232614 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agatcttggaacctctcgcctcgttccttccctcgctccg

SEQ ID NO: 232615 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agagcccgtcgagtcatctttcaaagactactttgaatac

SEQ ID NO: 232616 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agacccgggttccacctcagtccccaaaatgcgcgcattt

SEQ ID NO: 232617 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agaagtccgcggtttcactagactactactgatcacgtcg

SEQ ID NO: 232618 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acttcatcatggtctgtgtagttgactacaacttttagta

SEQ ID NO: 232619 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actgtaggcacctgctctatgtcgtggagagtaacaggtt

SEQ ID NO: 232620 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actaccatcgtctagtgagtcacccttagttcatcaaggc

SEQ ID NO: 232621 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgtttcttcctcagcttccgcggtgcaggatttgcacgt

SEQ ID NO: 232622 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgcaccccgatagtcatcttcactggaccacccgtgtta

SEQ ID NO: 232623 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttcctcagcttccgcggtgcgggatttgcacgt

SEQ ID NO: 232624 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgagcactggactctcagcgcgcgacccatctctcagta

SEQ ID NO: 232625 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgactctccctcagcttccgcggtgcaggatttgcacgt

SEQ ID NO: 232626 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgactcctcctcagcttccgcggtgcaggatttgcacgt

SEQ ID NO: 232627 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acctgatcttgacgtctcttcggggactaccccgattctg

SEQ ID NO: 232628 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accggcctcaggttccctaacgcgttagccttccggaatg

SEQ ID NO: 232629 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgaacctgtggctgtttgcgactacccaattagggcta

SEQ ID NO: 232630 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagtgggctccatgctttaggcgcctcttattttgggtc

SEQ ID NO: 232631 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcacttggactctcagcgcgcgacccatctctcagta

SEQ ID NO: 232632 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactggactctcagcgtcgcgacccatctctcagta

SEQ ID NO: 232633 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactggactctcagcgcgcgaccccatctctcagta

SEQ ID NO: 232634 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaggtcatcgtttaaccgtttgttgcaa

SEQ ID NO: 232635 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgtttgtcgcaa

SEQ ID NO: 232636 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggccttcaccgtcctcaatacgggcgaatg

SEQ ID NO: 232637 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactactccggtaagtcatcgtttaaccgtttgttgcaa

SEQ ID NO: 232638 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacatacgcctgggtcactccttgttctg

SEQ ID NO: 232639 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacatacgcctgggtcactcattgttctg

SEQ ID NO: 232640 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacatacgcctgggtcaccctttgttctg

SEQ ID NO: 232641 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacacacgcctgggtcactctttgttctg

SEQ ID NO: 232642 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatctcgagatcactaggcgctatcctagcactgtatcaa

SEQ ID NO: 232643 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcatagtaattctgcccctctgatgaaaccggttactt

SEQ ID NO: 232644 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattctgccctctgaatgaaaccggttactt

SEQ ID NO: 232645 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattctgcccctctgatgaaaccggttacct

SEQ ID NO: 232646 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattctgcccctctgatgaaaccagttactt

SEQ ID NO: 232647 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattctgcccccctgatgaaaccggttactt

SEQ ID NO: 232648 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatactggcctcggtacgttcttctccatcgctcttctcg

SEQ ID NO: 232649 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatacgccgcctcggatacggtcgtgatcgtagttcctcg

SEQ ID NO: 232650 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagcgttttgtatgtgtcgcacgctattgcgaggtaacat

SEQ ID NO: 232651 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccggggcccgcctcaagctagctacctaccattgtctg

SEQ ID NO: 232652 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaattagtactgacggccgccttgatcctccgttagtctg

SEQ ID NO: 232653 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaatcttacaggcagccacgcctcgttcctcctttttctg

SEQ ID NO: 232654 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaatccgggccgcctcaagctagctacctccattgtcctg

SEQ ID NO: 232655 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaactggtgttgcaggctactgcatctcaagcattctccg

SEQ ID NO: 232656 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgtggcccgcctcaagctagctacctccattgtctg

SEQ ID NO: 232657 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccgccttcaagctagctacctccattgtctg

SEQ ID NO: 232658 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccgcctcaagctagctaccttccattgtctg

SEQ ID NO: 232659 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccgcctcaagctagctacctcccattgtctg

SEQ ID NO: 232660 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgctcaagcctagctacctccattgtctg

SEQ ID NO: 232661 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaaggtagctacctccattgtctg

SEQ ID NO: 232662 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctgcctccgttgtctg

SEQ ID NO: 232663 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacgtccattgtctg

SEQ ID NO: 232664 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctctactgtctg

SEQ ID NO: 232665 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccttatgtcg

SEQ ID NO: 232666 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctcctattgtcg

SEQ ID NO: 232667 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccattgtctt

SEQ ID NO: 232668 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccattctctg

SEQ ID NO: 232669 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccatggtctg

SEQ ID NO: 232670 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccagtgtctg

SEQ ID NO: 232671 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctaccgccattgtctg

SEQ ID NO: 232672 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagcctagctacctccattgctg

SEQ ID NO: 232673 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagcaagctacctccattgtctg

SEQ ID NO: 232674 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcccacagtcagctacctccattgtctg

SEQ ID NO: 232675 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcatcaagctagctacctccattgtctg

SEQ ID NO: 232676 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctagctacctccattggtctg

SEQ ID NO: 232677 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgccctcaagctagctacctccattgtctg

SEQ ID NO: 232678 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggagcccgcctcaagctagctactccattgtctg

SEQ ID NO: 232679 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcctcaagctagctacctccatcgtctg

SEQ ID NO: 232680 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaaccgggcccgcctcaagctagctacctccattgtctg

SEQ ID NO: 232681 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttttccaactggtcgcgatacagaatacgattaacataaa

SEQ ID NO: 232682 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttttagtctcccgttcgcacgtactttccatcactgcatg

SEQ ID NO: 232683 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttttagtctcccgctcgcacgtactttccatcactgcatg

SEQ ID NO: 232684 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttgtgttagtaagtgcgaccgcctcattcctccctaata

SEQ ID NO: 232685 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttgggcttttaagcacttctcggtaacttgagcagttac

SEQ ID NO: 232686 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttggcggctatcgaacgctatttcgagataaggcttgtt

SEQ ID NO: 232687 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttctggaaatcgaactgcccttgcgcttaagtgcaaccg

SEQ ID NO: 232688 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttctcttttcggccgctatcccgattatgcggaaaaccg

SEQ ID NO: 232689 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttctctttcgggcgctatcccgattatgcggaaaaaccg

SEQ ID NO: 232690 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttcgcgatagcctcggttcttccatgcagctgcgtatta

SEQ ID NO: 232691 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttattctcccaaagccgcctcgcggacgtgtacacgaac

SEQ ID NO: 232692 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttattcggcctggttgcgcctcgatcctccagcggcctg

SEQ ID NO: 232693 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttacgtaaaatgcctgggtcccctatagattgatttgtg

SEQ ID NO: 232694 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttaatgcgcaccagctaatagcatggtccccttaaactg

SEQ ID NO: 232695 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttaaggcgctaccagctaattagcatggccccttaactg

SEQ ID NO: 232696 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttaagcgctaccagctaatagcatggaccccttaaactg

SEQ ID NO: 232697 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttaagcgctaccagcctaatagcagtggccccttaactg

SEQ ID NO: 232698 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttaagcgcacccagtctaatagcatggcccctttaactg

SEQ ID NO: 232699 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttaagcgcaccagtctaatcagcatggccccttaacttg

SEQ ID NO: 232700 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttaagcgcaccaggctaatagtccatggccccttaactg

SEQ ID NO: 232701 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttaagcgcaaccagctaattaggcgtggccccttaactg

SEQ ID NO: 232702 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttaagcgcaaccagctaattaggcatggccccttaactg

SEQ ID NO: 232703 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttaagcgcaaccagctaattaggaccatgcccttaactg

SEQ ID NO: 232704 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttaagcgcaaccagctaattaggacatgccccttaactg

SEQ ID NO: 232705 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttaagcgcaaccagctaattagccatggccccttaactg

SEQ ID NO: 232706 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttaaagcgctaaccagctaatagcatggccccttaactg

SEQ ID NO: 232707 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgtatggccgcctcgcaatatcgatatgtaaaacgtctg

SEQ ID NO: 232708 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgtagttcctccacttcgtccatccctaaggccggctta

SEQ ID NO: 232709 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgtaccccgggttgcaattgcctcgtaacaagaccgcat

SEQ ID NO: 232710 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgtaccccgggttgcaatcgcctcgtaaccagaccgcat

SEQ ID NO: 232711 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgtaccccgggttgcaactgcctcgtaaccagaccgcat

SEQ ID NO: 232712 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgtaccccgggctgcaatcgcctcgtaaccagaccgcat

SEQ ID NO: 232713 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttggtgcgcaacaaccgcctttgcgccgttaactagttaa

SEQ ID NO: 232714 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttggggcttttaagcacttctcggtaacttgggcagttac

SEQ ID NO: 232715 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgggccaagtttagcctctgtcctgttgcgtacgcactt

SEQ ID NO: 232716 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgggaaagactttaggccgcctcgctcctccgttggccg

SEQ ID NO: 232717 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgggaaagactttaggccgcctcgctcctccgttggcca

SEQ ID NO: 232718 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttggaggctttaagcacttctcggtaacttgggcagttac

SEQ ID NO: 232719 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgctcctgcgttacgtctgtgatcgactaccttcgtaat

SEQ ID NO: 232720 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgctcctgcgctacgtctgtgatcgactaccttcataat

SEQ ID NO: 232721 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgagtgtacactaatgtccgcttcttggatgccacatag

SEQ ID NO: 232722 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgactaccttcgctgctgtgtactcgtcctttttgtctg

SEQ ID NO: 232723 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcttcgtaggccctcgcgtttggcgagagccaattggcg

SEQ ID NO: 232724 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcttcgtaggccctcgcgtttggcgagacccaattggcg

SEQ ID NO: 232725 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcttcatggggtttttggggactaccccattggcaacac

SEQ ID NO: 232726 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcttactccggcaggacgtctttcgtgcactatcacgat

SEQ ID NO: 232727 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttctatcaggccgggacgtctttcgtgcactatcacgatt

SEQ ID NO: 232728 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcgtgtcttacccggtccgcctcgtttcctcttgttctg

SEQ ID NO: 232729 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcgcgatagcctcggttcttccatgccagctgcatatta

SEQ ID NO: 232730 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcgcgatagcctcggttctcccatgcagctgcatattta

SEQ ID NO: 232731 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcgcgatagccctcggttcttccatgcagctgcatatta

SEQ ID NO: 232732 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcgcgatacgcctcggttcttccatgcagctgcatatta

SEQ ID NO: 232733 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcgcgaacgccttagtcactcttctcggataacatgatt

SEQ ID NO: 232734 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcgcgaacgccttagtcacccttctcggatgacatgatt

SEQ ID NO: 232735 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcgcgaacgccttagtcacccttctcggatagcatgatt

SEQ ID NO: 232736 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcgcgaacgccttagtcacccttctcggataacacgatt

SEQ ID NO: 232737 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcgcgaacgccctagtcacccttctcggataacatgatt

SEQ ID NO: 232738 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcgcacagctcacttcgctttgatcgaccacgctcataa

SEQ ID NO: 232739 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcctgggactcatttgggactacccagagcaagagtatc

SEQ ID NO: 232740 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttccgggtacgctcgactacgaccggtacaccctgtacag

SEQ ID NO: 232741 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttccggaacgcctcgatcctcgcatagtatgatacgtctg

SEQ ID NO: 232742 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttccgcgatagcctcggttcttccatgcagctgcatatta

SEQ ID NO: 232743 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttccaagacgattgtcgttattgccggactacctgcattt

SEQ ID NO: 232744 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcaatggcgctaacagctaattagctggccccctaatgc

SEQ ID NO: 232745 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcaagcgcaccaggcctaatagcactggacccttaactg

SEQ ID NO: 232746 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttatgacgtcggttcgcctcgggtccatcctaattgtctg

SEQ ID NO: 232747 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttatgacgtcggttcgcctcgagtccatcccaattgtctg

SEQ ID NO: 232748 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttatgacgtcggttcgcctcaggtccatcccaattgtctg

SEQ ID NO: 232749 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttatgacgtcggtccgcctcgggtccatcccaattgtctg

SEQ ID NO: 232750 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttatgacatcggttcgcctcgggtccttcccaattgtctg

SEQ ID NO: 232751 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttatccctgatggtccgaattctcatcggctggcactatc

SEQ ID NO: 232752 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttatccctgatgatccgaattctcatcggccggcactatc

SEQ ID NO: 232753 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttatccctgatgacccgaattctcatcggctggcactatc

SEQ ID NO: 232754 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttatccctcgatgatccgaattctcatcgctggcactatc

SEQ ID NO: 232755 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttatccccgatgatccgaattctcatcggctggcactatc

SEQ ID NO: 232756 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttaggggctttaagcacttccggtaacttgggccagttac

SEQ ID NO: 232757 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttagggactgtaaaataagacaagggaccacccttgtttt

SEQ ID NO: 232758 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttagctagcgcctcgttcctgatacgcgcgttacctatgt

SEQ ID NO: 232759 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttagaatgtgtgatagtctcgggcattgctgcctcctcat

SEQ ID NO: 232760 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttagaatgtgtgatagtctcgggcattcctgcctcctcat

SEQ ID NO: 232761 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttactttctcggatcactaatcgccgcatcacgcactccc

SEQ ID NO: 232762 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttactttctcggatcactaactgccgcatcacgcactccc

SEQ ID NO: 232763 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttaccttctcggatcactaattgccgcatcacgcactccc

SEQ ID NO: 232764 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttaagcggctaccagctattagcactgtccctttgactcg

SEQ ID NO: 232765 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttaactttctcggatcactaattgccgcatcacgcactcc

SEQ ID NO: 232766 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttaaccgacctatccatgcgcgcaaacggttctcgatctg

SEQ ID NO: 232767 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgttgatcgttcttatccgcctcggtcttccccaggttaa

SEQ ID NO: 232768 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgttcgccagtcacatcaactatgatgacgcttggctgga

SEQ ID NO: 232769 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgttcgccagccacatcaactatgatgacgctcgactgga

SEQ ID NO: 232770 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgttacccggttgcaattgcctcgtaacctagaaccgcat

SEQ ID NO: 232771 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgtaacgttgcagccgtctctaaactgcagtgcaacct

SEQ ID NO: 232772 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgtaacgttacagccgtccctaaactgcagtgcaacct

SEQ ID NO: 232773 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgggtcgcctggtccgcctcgatcctctataccgtctg

SEQ ID NO: 232774 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgggtcgcctgatccgcctcgatcctctataccgtctg

SEQ ID NO: 232775 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtggggcttttaagcacttccggtaacttgggcagttac

SEQ ID NO: 232776 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtggggcttttaagcactctcggtaacttgggcagttac

SEQ ID NO: 232777 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgggcttttaagcacttctcggtaacttgggcagttac

SEQ ID NO: 232778 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgggcttttaagcacttctcggtaacttaggcagttac

SEQ ID NO: 232779 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgggctttaacgcacttctcggtaacttgggcagttac

SEQ ID NO: 232780 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtggacgtcaacgctgccttgttccttcaggtgccaccg

SEQ ID NO: 232781 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgcgactacgctcttgaacaattctgatccctggatct

SEQ ID NO: 232782 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgcgactacgctcttgaacaattccgatccctggattt

SEQ ID NO: 232783 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgaggcgaacaagccatgtacaccgcccctctggctgc

SEQ ID NO: 232784 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgaggcgaacaaaccatgtacaccgcccctctggctgc

SEQ ID NO: 232785 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtctcgtctgcatactttcggaccgtctcgccctccatg

SEQ ID NO: 232786 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtctaatcggaagtcttctcaggaggttgggcactatcc

SEQ ID NO: 232787 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtcggtattccggaacatggcctctgctcctccacggat

SEQ ID NO: 232788 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtcgcaacgccttgattcaactctacagtgtgtctatga

SEQ ID NO: 232789 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtccgccagtcacatcaactatgatgacgcttgactgga

SEQ ID NO: 232790 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtccctgtgtcttgttgccacagacgttcagtgcccccg

SEQ ID NO: 232791 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtagttcgcctggtccgcctcgatcctccataccgtctg

SEQ ID NO: 232792 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgttcttatccgcctcggccttccccaggttaa

SEQ ID NO: 232793 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgtctggtccgcctcgatcctcaataccgtctg

SEQ ID NO: 232794 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggttcgcctcgatcctctataccgtctg

SEQ ID NO: 232795 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtctgcctcgatcctctataccgtctg

SEQ ID NO: 232796 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcttcgatcctctacaccgtctg

SEQ ID NO: 232797 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcctcggtcctctataccgtctg

SEQ ID NO: 232798 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcctcgatcctttataccgtctg

SEQ ID NO: 232799 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcctcgatcctctgtaccgtctg

SEQ ID NO: 232800 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcctcgatcctctatgccgtctg

SEQ ID NO: 232801 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcctcgatcctctatatcgtctg

SEQ ID NO: 232802 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcctcgatcctctataccgtcta

SEQ ID NO: 232803 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcctcgatcctctataccatctg

SEQ ID NO: 232804 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcctcgatcctctatacagtctg

SEQ ID NO: 232805 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcctcgatcctcaataccgcctg

SEQ ID NO: 232806 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcatcgatcctctataccgtctg

SEQ ID NO: 232807 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccacctcgatcctctataccgtctg

SEQ ID NO: 232808 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctgggtcgcctcgatcctctataccgtctg

SEQ ID NO: 232809 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggaccgcctcgatcctctataccgtctg

SEQ ID NO: 232810 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctgatccgcctcgatcctctataccgtctg

SEQ ID NO: 232811 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctagtccgcctcgatcctctataccgtctg

SEQ ID NO: 232812 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgccgggtccgcctcgatcctctatgccgtctg

SEQ ID NO: 232813 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgccgggtccgcctcgatcctctataccgtctg

SEQ ID NO: 232814 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcccggtccgcctcgatcctctataccgtctg

SEQ ID NO: 232815 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtagcctggtccgcctcgatcccctataccgtctg

SEQ ID NO: 232816 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtagatcgttcttgtccgcctcggtcttccccaggttaa

SEQ ID NO: 232817 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtagatcgttcttatccgcctcggtcttccctaggttaa

SEQ ID NO: 232818 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtagatcgttcttatccgcctcggtcttccccaggtaca

SEQ ID NO: 232819 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtagatcgttcttatccgcctcggtcttccccagattaa

SEQ ID NO: 232820 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtagatcgttcttatccgcctcggccttccccaggttaa

SEQ ID NO: 232821 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtagatcgttcttatccgcctcgatcttccctaggttaa

SEQ ID NO: 232822 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtagatcgttcctatccgcctcggtcttccccaggttaa

SEQ ID NO: 232823 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtagatcgctcttatccgcctcggtcttccccaggttaa

SEQ ID NO: 232824 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtagatcgcctggtccgcctcgatcctctataccgtcta

SEQ ID NO: 232825 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtacgtcgccgtgtccgcctcgatcctctataccgtctg

SEQ ID NO: 232826 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtacggtcgcctgtccgcctcgatcctctataccgtctg

SEQ ID NO: 232827 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtacgactacgctcttgaacaattctgatccctggattt

SEQ ID NO: 232828 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtacatacgcctcgattgcgcaaggtagctcctgagatg

SEQ ID NO: 232829 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaagtcgcctggtccgcctcgatcctctataccgtatg

SEQ ID NO: 232830 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaagtcgcccggtccgcctcgatcctctataccgtctg

SEQ ID NO: 232831 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaacttctccctacatccgcctcgacaagtggccacca

SEQ ID NO: 232832 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggtcgtctcgttccttccttccggatccgtgtactgctg

SEQ ID NO: 232833 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggtcgatccgtactttcaggcgctatcctgatcacccga

SEQ ID NO: 232834 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggtacctaggatcaccgtctcagtaaccttaagtagcta

SEQ ID NO: 232835 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggtaaaccacaaatcgagcgtatcatctggtcttcgtta

SEQ ID NO: 232836 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgggctttcttcatggactaccatgttgcaaaaggtcata

SEQ ID NO: 232837 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgggctttcctcatggactaccatgttacaaaaggtcata

SEQ ID NO: 232838 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgggccatggatcactgcctcgattcgtccacgtggtggc

SEQ ID NO: 232839 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgggactctctcggatcgctctgtcctccgatatctgctg

SEQ ID NO: 232840 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggctgagctcacaccgcctcgaaaaggctagccacggat

SEQ ID NO: 232841 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggccaggcctcgatcacctatcttgcgcaagacatacaa

SEQ ID NO: 232842 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggagtccgcggtttcactagactactactgatcacgtcg

SEQ ID NO: 232843 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggacccgggcacttgcctcagttctctctacgggcgaat

SEQ ID NO: 232844 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggaagtccgcggttcactagactactactgatcacgtcg

SEQ ID NO: 232845 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggaaatctcgggtcggtatgcacgtgcttcttctccccg

SEQ ID NO: 232846 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgctcttgcaagaaatccacttcgaatccgacctgttctg

SEQ ID NO: 232847 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgctatccgaatcgagcttgagtgtctggttaaacaacga

SEQ ID NO: 232848 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgctacccccatcgagcgagtctactctcccatcaacggg

SEQ ID NO: 232849 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgtaaacgctattttctgggaaccgcatctcgagctaa

SEQ ID NO: 232850 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgtaaacgctattttctggaagccgcatctcgagcgaa

SEQ ID NO: 232851 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgtaaacgctatttctgggaagccgcatctcgagctaa

SEQ ID NO: 232852 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgtaaacgctatttctgggaagccgcatctcgagcgaa

SEQ ID NO: 232853 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgtaaacgctatttctggaatgccgcatctcgagcgaa

SEQ ID NO: 232854 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgctacctcgtcgtctgtggttttagtgaaaatgagaa

SEQ ID NO: 232855 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcgactacgctcttgaacaattctgatccctggattt

SEQ ID NO: 232856 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgccacgccttgattcactcctacagtgtgtctataga

SEQ ID NO: 232857 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcactagcctcgaactataagaatcttcctgggttgt

SEQ ID NO: 232858 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgattcgctcctacagtgtgtctataga

SEQ ID NO: 232859 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgattcattcctacagtgtgtctataga

SEQ ID NO: 232860 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgattcactcttacagtgtgtctataga

SEQ ID NO: 232861 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgattcactcctatagtgtgtctataga

SEQ ID NO: 232862 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgattcactcctacggtgtgtctatgga

SEQ ID NO: 232863 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgattcactcctacagtgtgtgtataga

SEQ ID NO: 232864 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgattcactcctacagtgtgtccataga

SEQ ID NO: 232865 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgattcactcctacagtgtgcctataga

SEQ ID NO: 232866 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgattcactcctacagtatgtctataga

SEQ ID NO: 232867 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgattcacgcctacagtgtgtctataga

SEQ ID NO: 232868 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgatcacttcctacagtgtgtctataga

SEQ ID NO: 232869 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgactctctcctacagtgtgtctataga

SEQ ID NO: 232870 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgactcactcctacagtgtgtctataga

SEQ ID NO: 232871 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgcctcgatccgtcgcataatatgatacgtctg

SEQ ID NO: 232872 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccctgattcactcctacagtgtgtctataga

SEQ ID NO: 232873 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaaagccttgattcactcctacagtgtgtctataga

SEQ ID NO: 232874 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaggcgctattttctgggaagccgcatctcgagcgaa

SEQ ID NO: 232875 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgagacgctattttctgggaagccgcatctcgagcgaa

SEQ ID NO: 232876 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaacgctattttctgggaagccgcatctcgagctgaa

SEQ ID NO: 232877 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaacgctatttctgggaatgccgctatctcgagcgaa

SEQ ID NO: 232878 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaacgctatttctgggaagccgcatcctcgagctgaa

SEQ ID NO: 232879 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaacgctatttctgagaagccgtcaatctcgagcgaa

SEQ ID NO: 232880 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaacgctatttcgtggaagccgcatcctcgagctgaa

SEQ ID NO: 232881 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgtctattttctgggaaccgcatctcgagcgaa

SEQ ID NO: 232882 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgtctatttctgggaagccgcatctcgagtgaa

SEQ ID NO: 232883 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctcattttctgggaaccgcatctcgagcgaa

SEQ ID NO: 232884 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctcatttctgggaagccgcatctcgagcgaa

SEQ ID NO: 232885 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttttgggaagccgcatctcgagcgaa

SEQ ID NO: 232886 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctggggagccgcatctcgagcgta

SEQ ID NO: 232887 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctggggagccgcatcccgagcgaa

SEQ ID NO: 232888 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagtcgcatctcgagcgaa

SEQ ID NO: 232889 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagctgcgtctcgagcgaa

SEQ ID NO: 232890 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgtatcccgagcgaa

SEQ ID NO: 232891 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcttctcgagcgaa

SEQ ID NO: 232892 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcgtctcgagcgta

SEQ ID NO: 232893 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcgtctcgagcgga

SEQ ID NO: 232894 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcgtctcgagcgag

SEQ ID NO: 232895 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcgtctcaagcgaa

SEQ ID NO: 232896 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcgcctcgagcgaa

SEQ ID NO: 232897 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatctctagcgaa

SEQ ID NO: 232898 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatctcgtgcgaa

SEQ ID NO: 232899 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatctcgagctaa

SEQ ID NO: 232900 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatctcgagcgta

SEQ ID NO: 232901 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatctcgagcggg

SEQ ID NO: 232902 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatctcgaccgtc

SEQ ID NO: 232903 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatctcgaacgaa

SEQ ID NO: 232904 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaaccgctgtctcgagcgaa

SEQ ID NO: 232905 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaacccgcatctcgagcgaa

SEQ ID NO: 232906 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttccggaggaccgcatctcgagcgaa

SEQ ID NO: 232907 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttccgatggaccgcatctcgagcgaa

SEQ ID NO: 232908 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttatgggaagccgcatctcgggcgaa

SEQ ID NO: 232909 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttctgggaatgccgcgtctcgagcgaa

SEQ ID NO: 232910 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttctcgggaagccgcatctcgagcgaa

SEQ ID NO: 232911 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttcctgggaagccgcatcccgagcgaa

SEQ ID NO: 232912 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattctctgggaagccgcatctcgagcgaa

SEQ ID NO: 232913 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatattctgggaagccgcatctcgagcgaa

SEQ ID NO: 232914 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgccttgattcactcctacagtgtgtctataga

SEQ ID NO: 232915 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaaacgctattttctgggaaccgcatctcgagcgaa

SEQ ID NO: 232916 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcctgattccggaacatgcacgtctcgtcttcgtctgcg

SEQ ID NO: 232917 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcctcgttccttcaggtatggccatactatcctctcgtc

SEQ ID NO: 232918 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgccggaagtccctcctcgtcttggtgcactatcatctca

SEQ ID NO: 232919 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgccggaacgcctcgatcctcgcataatatgatacgtctg

SEQ ID NO: 232920 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgccgcctctacatattgcgcaatagttatcttcggtgca

SEQ ID NO: 232921 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgccgcctcatcatcggacacgacgtgtatcagtgggctg

SEQ ID NO: 232922 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcattgttccagtcttctcccacagcggctggcactatc

SEQ ID NO: 232923 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcagcacgccttgattcactcctacagtgtgtctataga

SEQ ID NO: 232924 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcacaggtgttaattgcctccggtccttccgtgtgcaca

SEQ ID NO: 232925 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcacagcctcggtcctctcttgggctcacctgcaggcaa

SEQ ID NO: 232926 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatttttacactgcaccctctggccaccggtaccctagt

SEQ ID NO: 232927 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgattcttcccggccgctacgcttgcaacgtaaaatgaca

SEQ ID NO: 232928 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgattcgccagtcacatcaactatgatgacgcttgactga

SEQ ID NO: 232929 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgattcgcagtcacatcaactatgatgacgcttgactgga

SEQ ID NO: 232930 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgattccgctgtacgctacatcgactctgcatgactctga

SEQ ID NO: 232931 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgattcagtgtgcatccccgcctcagtcactccatgtgca

SEQ ID NO: 232932 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgtccatgagcttctggcactatccagttgacgctca

SEQ ID NO: 232933 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggcttttaagcacttctggtaacttgggcggttac

SEQ ID NO: 232934 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggcttttaagcacttctcgtaacttgggtagttac

SEQ ID NO: 232935 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggcttttaagcacttctcgtaacttgggcagttac

SEQ ID NO: 232936 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggctttaagcactttctcggtaacttggcagttac

SEQ ID NO: 232937 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggctttaagcacttcttggtaacttggggagttac

SEQ ID NO: 232938 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggctttaagcacttctcggtaactttggcagttac

SEQ ID NO: 232939 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggctttaagcacttctcggtaacttgggcagttgc

SEQ ID NO: 232940 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggctttaagcacttctcggtaaccttgggcgttac

SEQ ID NO: 232941 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggctttaaagcactttctgggatacctggcagtac

SEQ ID NO: 232942 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggcctttaagcacttctcggtacttgggcagttac

SEQ ID NO: 232943 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatggcttaaagcactttctcgggatacctggcagtaac

SEQ ID NO: 232944 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatcttactgggaagttgtatgtcccttttaacgtaacg

SEQ ID NO: 232945 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatccctaacgagccattctttcgcgcactatcgcgatt

SEQ ID NO: 232946 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatagaaatttcgcccgccttgcgcctcttacatcgccg

SEQ ID NO: 232947 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgagttcccggggctcaccgcctctgtcttatagaatgcg

SEQ ID NO: 232948 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgagtccctcctagtctcggatatctttaagcccgcatca

SEQ ID NO: 232949 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgagggcttttaagcacttctcggtaacttgggcagttac

SEQ ID NO: 232950 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaggcttaagctactttctcggataccttaggtcagtac

SEQ ID NO: 232951 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaggcgttttaagcacttctcggtaacttgggcagttac

SEQ ID NO: 232952 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgagctcccgcctcgtgtctggaacgttctggagactgcg

SEQ ID NO: 232953 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgagccatggatcattgcctcgattcgtccacgtggtggc

SEQ ID NO: 232954 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgagcaacgccttgattcactcctacagtgtgtctataga

SEQ ID NO: 232955 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgagatttccgcctcggtatgccgccttgttctccttgta

SEQ ID NO: 232956 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgagagtctcgcggtccgcttcgcgccttctatctcgctg

SEQ ID NO: 232957 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgacttactggaagttgtgatgtcccattttaacgtaacg

SEQ ID NO: 232958 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgacgaacgcttatttctgggaagccgcatctcgagcgaa

SEQ ID NO: 232959 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaccgcctcatctatcggacacgactgtatcagttgctg

SEQ ID NO: 232960 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaccgcctcatctatcggacacgactcgtatcagtgctg

SEQ ID NO: 232961 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaccgcctcatctatcggacacgacgtgtatcagtgctg

SEQ ID NO: 232962 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaccgcctcatcatcggacacgacgtgtatcgagtgctg

SEQ ID NO: 232963 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaccgcctcatcatcggacacgacgtgtatcagttgctg

SEQ ID NO: 232964 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgacattccggatatcagaacgcctcagtcatcccaataa

SEQ ID NO: 232965 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaattctagcttctccgcctcgatctttccaagtcgctg

SEQ ID NO: 232966 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgtggtttcactagactactactgatcacgtcg

SEQ ID NO: 232967 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgctggttcactagactactactgatcacgtcg

SEQ ID NO: 232968 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcgtattcactagactactactgatcacgtcg

SEQ ID NO: 232969 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggttttactagactactactgatcacgtcg

SEQ ID NO: 232970 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagagtactactgatcacgtcg

SEQ ID NO: 232971 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagactactactgatcacgtgg

SEQ ID NO: 232972 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagactactactgaccacgtcg

SEQ ID NO: 232973 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagaccactactgatcacgtcg

SEQ ID NO: 232974 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggttccactagactactactgatcacgtcg

SEQ ID NO: 232975 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggttcactgagactactactgatcacgtcg

SEQ ID NO: 232976 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggttcactagactactacctgatcacgtcg

SEQ ID NO: 232977 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaaggtccgcggttcactagactactactgatcacgtcg

SEQ ID NO: 232978 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagcccgcggtttcactagactactactgatcacgtcg

SEQ ID NO: 232979 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttgctagcggattcgtctcgacctccccatgcgctgta

SEQ ID NO: 232980 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttctacgccgaggacgtctttcgtgcactatcacgatt

SEQ ID NO: 232981 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctgtcgcgatacagaatacgtattaacataaa

SEQ ID NO: 232982 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgtgatacagaatacgattaacataaa

SEQ ID NO: 232983 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacggttaacataaa

SEQ ID NO: 232984 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgattagcataaa

SEQ ID NO: 232985 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgattaatataaa

SEQ ID NO: 232986 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgattaacttaaa

SEQ ID NO: 232987 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgattaacatcaa

SEQ ID NO: 232988 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgattaacatata

SEQ ID NO: 232989 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgattaacacaaa

SEQ ID NO: 232990 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgattaacaaaaa

SEQ ID NO: 232991 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgatgaacataaa

SEQ ID NO: 232992 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgacacagaatacgattaacataaa

SEQ ID NO: 232993 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggccgcgatacagaatacgattaacataaa

SEQ ID NO: 232994 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatccggtcgcgatacagaatacgattaacataaa

SEQ ID NO: 232995 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccacctgtcgcgatacatgaatacgattaacataaa

SEQ ID NO: 232996 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctgtgatctgttatcgagcactatctcgtcgctacggag

SEQ ID NO: 232997 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctgggcttttaagcacttctcggtaacttgggcagttac

SEQ ID NO: 232998 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctgctctcggatctaaatgtgctgtacatcctcctcccg

SEQ ID NO: 232999 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctctatccggcaggacgtcttcgtgccactatcacgatt

SEQ ID NO: 233000 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctcgatctcttctgcccgggctttacttcttcgactgta

SEQ ID NO: 233001 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctcctaagtttagtcgtctttcgaggactacctcgtttc

SEQ ID NO: 233002 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctcccaagtttagtcgtctttcgagggctacctcgtttc

SEQ ID NO: 233003 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctcccaagttcagtcgtctttcgaggactacctcgtttc

SEQ ID NO: 233004 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctagtctagacacctctcgtcgttacttagatgtgcgca

SEQ ID NO: 233005 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctagtccgctcatctctgactacagggaagattgaggga

SEQ ID NO: 233006 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctagggtcctgacgcactcctctaactcgaggcgtccca

SEQ ID NO: 233007 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctaggctttcacgcacgcggattgtacccggactgggtt

SEQ ID NO: 233008 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctactatcggcaggacgtcttctgctactatcacagatt

SEQ ID NO: 233009 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgtgatcagctagtcgtgctttgtccgctatgacattca

SEQ ID NO: 233010 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgtgatacttgaggtcgttgtgcgcttacgaaccctaat

SEQ ID NO: 233011 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgtacttaccaccctgacatcgcgggggaactaatggtt

SEQ ID NO: 233012 - skipped

SEQ ID NO: 233013 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgggtctcacgtcataccccgattccgagccgtcaattg

SEQ ID NO: 233014 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcggatgacttgagtcgttgtgcgcttacggaaccctaat

SEQ ID NO: 233015 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcggagatacgaatatttcgcgatcgcccctctgcctggg

SEQ ID NO: 233016 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgctcggctcacttcgtctttgatcgaccacgctcataa

SEQ ID NO: 233017 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcgcagctcacctcgtctttgatcgaccacgctcataa

SEQ ID NO: 233018 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcgcaacgcctcgatcctcgcataatatgatacgtctg

SEQ ID NO: 233019 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcgattacatcagtcccaggatcactaggttatgtcta

SEQ ID NO: 233020 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcgatcagctagtcgtgctttgtccgctatgacattca

SEQ ID NO: 233021 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcgaaacgctatttctgggaagccgcatctcgagcgaa

SEQ ID NO: 233022 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcctcggtctacccctaatgttgcaacataatggtaaa

SEQ ID NO: 233023 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcctccttcctccatgagcatgcttactcgggatactg

SEQ ID NO: 233024 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcctcaggttcccctaacgcgttagaccttccggaatg

SEQ ID NO: 233025 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcctcaggttcccctaacgcgttacgccttccggaatg

SEQ ID NO: 233026 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcccagctcactttgtctttgatcgaccacgctcataa

SEQ ID NO: 233027 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgccacagctcacttcgctttgatcgaccacgctcataa

SEQ ID NO: 233028 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcatagctcacttcgtctttgatcgaccacgctcataa

SEQ ID NO: 233029 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacaggctcacttcgtcttgatcgaccacgctcataa

SEQ ID NO: 233030 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctctacttcgtcttgatcgaccacgctcataa

SEQ ID NO: 233031 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcatttcgtctttgatcgaccacgctcataa

SEQ ID NO: 233032 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgattgaccacgctcataa

SEQ ID NO: 233033 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgtccacgctcataa

SEQ ID NO: 233034 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgatcacgctcataa

SEQ ID NO: 233035 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccatgctcataa

SEQ ID NO: 233036 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccacgctcacaa

SEQ ID NO: 233037 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccacgcgcataa

SEQ ID NO: 233038 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccacgcccataa

SEQ ID NO: 233039 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccacactcataa

SEQ ID NO: 233040 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaacacgctcataa

SEQ ID NO: 233041 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcacccacgctcataa

SEQ ID NO: 233042 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctctgatcgaccacgctcataa

SEQ ID NO: 233043 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgcctttgatcgaccacgctcatag

SEQ ID NO: 233044 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcactctgtctttgatcgaccacgctcacaa

SEQ ID NO: 233045 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcactccgtctttgatcgaccacgctcataa

SEQ ID NO: 233046 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctaacttcgtctttgatcgaccacgctcataa

SEQ ID NO: 233047 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagcgcacttcgtctttgatcgaccacgctcataa

SEQ ID NO: 233048 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagcccactccgtctttgatcgaccacgctcataa

SEQ ID NO: 233049 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgatgggctttagcacttctccgtaacttgggcagttac

SEQ ID NO: 233050 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgatgggcctttagacacttctccgtacttggcagttac

SEQ ID NO: 233051 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgatcgcccgtcacatcaactatgatgacgcttgctgga

SEQ ID NO: 233052 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgatcgccagcacatcacttatgactgacgcttactaga

SEQ ID NO: 233053 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgatccttcctcagcctccgcggtgcaggatttgcacgt

SEQ ID NO: 233054 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgatcacagctcacttcatcttgatcgacacgctcataa

SEQ ID NO: 233055 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgagtcgcgtatcgccatatgccggcattctcgtacact

SEQ ID NO: 233056 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgagacgttgagcacgttgcagatcgccctctgtacgta

SEQ ID NO: 233057 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgaagtccgcggttcactagactactactgatcacgtcg

SEQ ID NO: 233058 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccgcggctgcctcgatcttcccaacattctgtagcgctg

SEQ ID NO: 233059 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccgcctctgccttccagctacggtagcactataggccta

SEQ ID NO: 233060 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccgcaccccgatagtcatcttcactggaccacccgtgta

SEQ ID NO: 233061 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccgaatgcatgcgggctgcctcataagtgcacaatctac

SEQ ID NO: 233062 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccgaagtccccaattcgtgtccgtacgctattacggttt

SEQ ID NO: 233063 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcccgggtatggcctcgtcttctcgctcggatcgaactac

SEQ ID NO: 233064 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcccgcctcatcatcggacacgacgtgtatcagttggctg

SEQ ID NO: 233065 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccccttcatcggaattgacaactcaccccgttgtcttga

SEQ ID NO: 233066 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcccctccatcggaattgataactcaccccgttgtcttga

SEQ ID NO: 233067 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccatgggtacgccttcgattccgccatacatgcatgtaa

SEQ ID NO: 233068 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccatggctcggtcgtttgtcaaagactactttgatggtt

SEQ ID NO: 233069 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccatcagctgctggatttcctcgatcatcccagtctgta

SEQ ID NO: 233070 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccaagtcctcaattcgtcgtccgtacgctattacggttt

SEQ ID NO: 233071 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccaagtccccaattcgtcgtccgtacgctattacgtttt

SEQ ID NO: 233072 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccaagtccccaattcgtcgtccgcacgctattacggttt

SEQ ID NO: 233073 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatggggcttttaagcacttccgtgacttgggcagttac

SEQ ID NO: 233074 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatggggctttaagctacttctcgtacttgggcagttac

SEQ ID NO: 233075 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatggggctttaagcacttctcggtacttggcagttacc

SEQ ID NO: 233076 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggcttttaagcacttctcggtacttgggcagttac

SEQ ID NO: 233077 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggcttttaagcactctcggtaacttgggcagctac

SEQ ID NO: 233078 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttaagctacttctcggtaacttggcagttac

SEQ ID NO: 233079 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttaagcagcttctcgttacttggcagcttac

SEQ ID NO: 233080 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttaagcacttctcgtaacttgggcagcttac

SEQ ID NO: 233081 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttaagcacttctcggtaacttgggcagctta

SEQ ID NO: 233082 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttaagcacttctcggtaacttgggcagctac

SEQ ID NO: 233083 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttaagcacttctcggtaacttgagcagttac

SEQ ID NO: 233084 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttaagcacttcctggtaaccttggcagttac

SEQ ID NO: 233085 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatggctttagcgactcgtcgatacttcggcagcttatc

SEQ ID NO: 233086 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatcgcatccgttgcatccacctctgtgtatgctcatgc

SEQ ID NO: 233087 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatcgattgaccgcccctctgatcgctaaccggttacga

SEQ ID NO: 233088 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatcatggctgcccctctgccttattaggggccctaagg

SEQ ID NO: 233089 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatcatggctgcccctctgccttattaggagccctaagg

SEQ ID NO: 233090 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcagtattgctccgccttgcatcttccctctatggaccaa

SEQ ID NO: 233091 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcagggctttagctcacttctcggtaacttgggcagttac

SEQ ID NO: 233092 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcaggacacgctaatttcgtactgatcgcccctctgtgca

SEQ ID NO: 233093 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcagctgctcctgccagaaatcgtgctccctaacgttaag

SEQ ID NO: 233094 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcagaaaccagctttcgtgcactatcacgtatcctgctgt

SEQ ID NO: 233095 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcactatccgtttgtccgtcctctgtggtattgcgcatgc

SEQ ID NO: 233096 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcactatcccatcgagcgatcgtcgtaatactgcttccaa

SEQ ID NO: 233097 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcacgtatccgttgtccgtcctctgtcgtattaccgcata

SEQ ID NO: 233098 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcacgggctttaagcacttctcggtaacttgggcagttac

SEQ ID NO: 233099 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcacgcagctcacttcgtctttgatcgaccacgctcataa

SEQ ID NO: 233100 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcaccgctcatcatcggacacgacgtgtattcagttgctg

SEQ ID NO: 233101 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcaccgctcactcatcggacacgacgtgtatcagttgctg

SEQ ID NO: 233102 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcaccgcctcatcattggacacgacgtgtatcagttgctg

SEQ ID NO: 233103 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcaccgccctcatcatcggacacgactgtatcagttgctg

SEQ ID NO: 233104 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcacacagctcacttcgtctttgatcgaccacgctcataa

SEQ ID NO: 233105 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcaattctcggataatatcgcctcgattcccccatctgtg

SEQ ID NO: 233106 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcaattacactttaatggtatgacggcccctctgtgtacg

SEQ ID NO: 233107 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcaaccgcctcatcatcggacacgactgtatcagttgctg

SEQ ID NO: 233108 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcaaccgcctcatcatcggacacgacgtgatcagttgctg

SEQ ID NO: 233109 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcaaagcagtcggaacgctatttccggatttacgcgagac

SEQ ID NO: 233110 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatttgccagtcacatcaactacgatgacgcttgactgga

SEQ ID NO: 233111 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatttgcagctcacatcaactatgatgacgcttgactgga

SEQ ID NO: 233112 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattgtggcatttgggcgccattccccctaagaatctgcg

SEQ ID NO: 233113 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattgggctttaagtcgactctcgtaacttggctagttac

SEQ ID NO: 233114 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattgcgctagccacatcacttatgatgacgctgactgta

SEQ ID NO: 233115 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattgcgctagcacatcaactatgatgacgcttgactgga

SEQ ID NO: 233116 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattgcgcagtcacatccaactatgatgcgcttgactgga

SEQ ID NO: 233117 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattgccagctcacatcaactatgatgacgcttgactgga

SEQ ID NO: 233118 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgctagtcacatcaacttatgatgacgcttgactga

SEQ ID NO: 233119 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgctagtcacatcaactatgatgacgcttggctgga

SEQ ID NO: 233120 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcctgtcacatcaactatgatgacgcttggctgga

SEQ ID NO: 233121 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcctgtcacatcaactatgatgacgcttgactgga

SEQ ID NO: 233122 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcctagtcacatcaactatgatgactgctgactga

SEQ ID NO: 233123 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcctagtcacatcaactatgatgacgcttgactga

SEQ ID NO: 233124 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcctagtcacatcaactatgatacgcttgactgga

SEQ ID NO: 233125 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcctagcacatcaactatgatgacgcttgactgga

SEQ ID NO: 233126 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccgtcgacatcaacttatgatgacgctgactgga

SEQ ID NO: 233127 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccggtcacatcaactatgatggcgcttgactgga

SEQ ID NO: 233128 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcccgtcacatcaactatgatgacgcttgactgga

SEQ ID NO: 233129 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcccagtcacatcaactatgatgcgcttgactgga

SEQ ID NO: 233130 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcccagtcacatcaactatgatgacgcttgctgga

SEQ ID NO: 233131 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcccagcacatcactatgatgacgcttgacctgga

SEQ ID NO: 233132 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcccagcacatcaactatgatgacgcttgactgga

SEQ ID NO: 233133 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccatccacatcaactatgatgacgcttgactgga

SEQ ID NO: 233134 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccatacgagacaacttatgatgacgcttgactga

SEQ ID NO: 233135 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtctacatcaactatgatgacgcttgactga

SEQ ID NO: 233136 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcgacatcaactatgatgacgcttgactga

SEQ ID NO: 233137 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtccacatcaactatgatgacgcttgactga

SEQ ID NO: 233138 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtccacatcaactatgatgacgctgactgga

SEQ ID NO: 233139 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacattaactatgatgacgcttgactggc

SEQ ID NO: 233140 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatgaactatgatgacgcttgactgga

SEQ ID NO: 233141 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatccactatgatgacgcttggctgga

SEQ ID NO: 233142 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcagctatggtgacgcttgactgga

SEQ ID NO: 233143 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcagctatgatggcgcttgactgga

SEQ ID NO: 233144 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcagctatgatgacgcttggctgga

SEQ ID NO: 233145 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaattatgatgacgcttgactgga

SEQ ID NO: 233146 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgttgacgcttgactgga

SEQ ID NO: 233147 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgcgcttggactgga

SEQ ID NO: 233148 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgctttactgga

SEQ ID NO: 233149 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttgtctgga

SEQ ID NO: 233150 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttgacttga

SEQ ID NO: 233151 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttgactaaa

SEQ ID NO: 233152 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttgacggga

SEQ ID NO: 233153 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttaactgga

SEQ ID NO: 233154 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgctggactgga

SEQ ID NO: 233155 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgctagactgga

SEQ ID NO: 233156 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacacttgactgga

SEQ ID NO: 233157 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacactgatctgga

SEQ ID NO: 233158 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgataacgcttgactgga

SEQ ID NO: 233159 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgactgacgcttggctga

SEQ ID NO: 233160 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacaccaactatgatgacgcttggctgga

SEQ ID NO: 233161 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtaacatcaactatgatgacgcttgactgga

SEQ ID NO: 233162 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagctacatcaactatgatgacgcttgactgga

SEQ ID NO: 233163 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccgcatcaactatgatgacgcttgactgga

SEQ ID NO: 233164 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacattaactatgatgacgcttgactgga

SEQ ID NO: 233165 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatccactatgatgacgcttgactgga

SEQ ID NO: 233166 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaagtatgatgacgcttgactgga

SEQ ID NO: 233167 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaacttatgatgacgcttgactga

SEQ ID NO: 233168 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatggcgcttgactgga

SEQ ID NO: 233169 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgcgctttgactgga

SEQ ID NO: 233170 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgactcttgactgga

SEQ ID NO: 233171 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgacgcttgtctgga

SEQ ID NO: 233172 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgacgcttgacttga

SEQ ID NO: 233173 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgacgcttgactgaa

SEQ ID NO: 233174 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgactgacgctgactgga

SEQ ID NO: 233175 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgacgacgcttgcctgga

SEQ ID NO: 233176 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactataatgacgcttggctgga

SEQ ID NO: 233177 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaacaatgatgacgcttgactgga

SEQ ID NO: 233178 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacacaacttatgatgaccgcttgactga

SEQ ID NO: 233179 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagcacattcaactatgatgacgcttgactgga

SEQ ID NO: 233180 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagcacatcaactatgatgacgctttgactgga

SEQ ID NO: 233181 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagcacatcaactatgatgaacgcttgactgga

SEQ ID NO: 233182 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagacacatcaactatgatgacgcttgactgga

SEQ ID NO: 233183 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccaatcacatcaactatgatgacgcttggctgga

SEQ ID NO: 233184 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccaatcacatcaactatgatgacgcttgactgga

SEQ ID NO: 233185 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccaagtcacatcaactatgatgacgcttgctgga

SEQ ID NO: 233186 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccaaccacatcaactatgatgacgcttgactgga

SEQ ID NO: 233187 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcagtctacatcaactatgtgtgacgcttgctgga

SEQ ID NO: 233188 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcagtctacatcaactatgatgacgcttgactgga

SEQ ID NO: 233189 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcagtcacatcaacttatgatgacgcttgactgga

SEQ ID NO: 233190 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcagtcacatcaactatgattgacgcttgactgga

SEQ ID NO: 233191 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcagtcacatcaactatgatgacgctttgactgga

SEQ ID NO: 233192 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcagtcacatcaactatgatgacgcttgacctgga

SEQ ID NO: 233193 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcagtcacatcaactatgatgaacgcttgactgga

SEQ ID NO: 233194 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcacatcacatcaactatgatgacgcttgactgga

SEQ ID NO: 233195 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattccgtcgctgatatgttcccggaccatatcatacaag

SEQ ID NO: 233196 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcaccagtcacatcagctatgatgacgcttgactgga

SEQ ID NO: 233197 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcaccagtcacatcaactatgacgacgcttgactgga

SEQ ID NO: 233198 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattagccagtcacatcaactatgatgacgcttgactgga

SEQ ID NO: 233199 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgttaagcttacatacgcctgggtcactctttgttctg

SEQ ID NO: 233200 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggtccatgagcttctggcactatccagttgacgctca

SEQ ID NO: 233201 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggtctttaagcacttctcggtaacttgggcagttac

SEQ ID NO: 233202 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggttttaagcacttctcggtaacttgggcagttac

SEQ ID NO: 233203 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggtctttaagcacttctcggtaacttggcagttac

SEQ ID NO: 233204 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggggcttttagcacttctcggtaacttggcagttac

SEQ ID NO: 233205 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggggcttttaagcacttctcggtattggacagttac

SEQ ID NO: 233206 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggggcttttaagcacttcgtgaacttgggcagctac

SEQ ID NO: 233207 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttgagcacttctggtaacttgagcagttac

SEQ ID NO: 233208 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaggcacttctggtaacttgggcagttac

SEQ ID NO: 233209 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttagcacttctcggtaacttgggcggttac

SEQ ID NO: 233210 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttagcactctcggtaacttgggccagttac

SEQ ID NO: 233211 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttagagacttctcggtaacttggcagttac

SEQ ID NO: 233212 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttagacacttctcggtaacttggcagttac

SEQ ID NO: 233213 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagtactctctgtaacttgggcagttac

SEQ ID NO: 233214 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagctctctgtgatacttgggcagttac

SEQ ID NO: 233215 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagccttctcggtaacttgggcagttac

SEQ ID NO: 233216 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctggtagcttgggcagttac

SEQ ID NO: 233217 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctggtaacttgggctgttac

SEQ ID NO: 233218 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctggtaacttgggcagttat

SEQ ID NO: 233219 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctggtaacttggagagttac

SEQ ID NO: 233220 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctggtaacctgggcagttac

SEQ ID NO: 233221 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctgagaacttgggcagttac

SEQ ID NO: 233222 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcgtaacttgggaagttac

SEQ ID NO: 233223 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcgtaacttggccagttac

SEQ ID NO: 233224 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcgtaacttggacagttac

SEQ ID NO: 233225 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcgtaacttgagcagttac

SEQ ID NO: 233226 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcgtaacttaggcagttac

SEQ ID NO: 233227 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtgacttggcagttac

SEQ ID NO: 233228 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtatcgtggcagttac

SEQ ID NO: 233229 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtagttgggcagttac

SEQ ID NO: 233230 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtagcttgggcagtta

SEQ ID NO: 233231 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtacttaggcagttac

SEQ ID NO: 233232 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtacattggcagttac

SEQ ID NO: 233233 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaacttgggtattac

SEQ ID NO: 233234 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaacttgggcagttc

SEQ ID NO: 233235 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaactcgggcagtac

SEQ ID NO: 233236 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaacctggcagttac

SEQ ID NO: 233237 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttcgtgatacttgggcaattac

SEQ ID NO: 233238 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttcgtcatacttgggcagttac

SEQ ID NO: 233239 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttcctcgtacttgggcagttac

SEQ ID NO: 233240 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttccgtgtacttgggcagttac

SEQ ID NO: 233241 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttccgtgatacttggcagttac

SEQ ID NO: 233242 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttccggtaacttgagcagttac

SEQ ID NO: 233243 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttcccgtaacttgggcagttac

SEQ ID NO: 233244 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcactctcggtagcttgggcagttac

SEQ ID NO: 233245 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcactctcggtaacttgggcagttaa

SEQ ID NO: 233246 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcactcacgtacgttagtcgagttac

SEQ ID NO: 233247 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcactacgtcgtaacgtggcagttac

SEQ ID NO: 233248 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcaccttcggtaacttgggcagttac

SEQ ID NO: 233249 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacctctggtaacttgggcagttac

SEQ ID NO: 233250 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacctctgagaacttgggcagttac

SEQ ID NO: 233251 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacctctcggtaactgggcagttac

SEQ ID NO: 233252 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaaacacttccggtaacttgggcagttac

SEQ ID NO: 233253 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaaacactctctgtgacttgggcagttac

SEQ ID NO: 233254 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttcagcacttctcggtaacttgggcagttac

SEQ ID NO: 233255 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttagcacttctcggtaacttgggcagttacc

SEQ ID NO: 233256 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttagacaccttctcggtaacttggcagttac

SEQ ID NO: 233257 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttacagcacttcgtgatacttgggcagttac

SEQ ID NO: 233258 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttacagacttctcggtaacttgagcagttac

SEQ ID NO: 233259 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaatcacttctcggtaacttgggcagctac

SEQ ID NO: 233260 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagctacttctcggtaacttggcagttac

SEQ ID NO: 233261 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcactttctcggtaacttggcagttac

SEQ ID NO: 233262 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcgtaacttgggcagcttac

SEQ ID NO: 233263 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcgtaacttgggacagttac

SEQ ID NO: 233264 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtacattgggcagttac

SEQ ID NO: 233265 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttggtcagttac

SEQ ID NO: 233266 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttgggcagttgc

SEQ ID NO: 233267 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttggcgagttac

SEQ ID NO: 233268 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttggccagttac

SEQ ID NO: 233269 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttggccagatac

SEQ ID NO: 233270 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttggagagttac

SEQ ID NO: 233271 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaactggggcagttac

SEQ ID NO: 233272 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaactagggcagttac

SEQ ID NO: 233273 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacgttggcagttac

SEQ ID NO: 233274 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcgataacttgggcagttac

SEQ ID NO: 233275 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctaggtaacttgggcagttac

SEQ ID NO: 233276 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttccgtgatacttgggcagttac

SEQ ID NO: 233277 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttcccggtaacttgggcagttac

SEQ ID NO: 233278 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttcacggtaacttgggcagttac

SEQ ID NO: 233279 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttcacggtaacttgggcagctac

SEQ ID NO: 233280 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcactcctcggtaacttgggcagttac

SEQ ID NO: 233281 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcactcctcggtaacttaggcagttac

SEQ ID NO: 233282 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacctctcggtaacttgggccgttac

SEQ ID NO: 233283 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaacacacttctcggtaacttggcagttac

SEQ ID NO: 233284 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaaacacttctcggtaacttgggcagttac

SEQ ID NO: 233285 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttctaagcattctcggtaacttgggcagttac

SEQ ID NO: 233286 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttctaagcacttctcggaacttgggcagttac

SEQ ID NO: 233287 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttatagcacttctcggtaacttgagcagttac

SEQ ID NO: 233288 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttactagcacttctcgtaacttgggcagttac

SEQ ID NO: 233289 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttactagacttctcggtaacttgggcagttac

SEQ ID NO: 233290 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttacagcacttctcggtaacttgggcagttac

SEQ ID NO: 233291 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcgtttaagcacttctcggtaacttggcagttac

SEQ ID NO: 233292 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcctttaagcacttctggtaacttgggcagttac

SEQ ID NO: 233293 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcctttaagcacttctcgtaacttgggcagttac

SEQ ID NO: 233294 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcctttaagcacttctcggtaacttgggcattac

SEQ ID NO: 233295 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcctttaagcacttctcggtaactgggcagttac

SEQ ID NO: 233296 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggccttaagcacttctcggtaacttgggcagttac

SEQ ID NO: 233297 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttgagcactcctcggtaacttgggcagttac

SEQ ID NO: 233298 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagccacttctcggtaacttggcagttac

SEQ ID NO: 233299 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctggataacttgggcagttac

SEQ ID NO: 233300 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcgtaactttgggcagttac

SEQ ID NO: 233301 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcgtaacttggggcagttac

SEQ ID NO: 233302 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacttggtcagttac

SEQ ID NO: 233303 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacttgggtagttac

SEQ ID NO: 233304 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacttggggagttac

SEQ ID NO: 233305 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacttgggctattac

SEQ ID NO: 233306 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacttgggcggttac

SEQ ID NO: 233307 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacttgggcagttat

SEQ ID NO: 233308 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacttgggcaattac

SEQ ID NO: 233309 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacttggcgagttac

SEQ ID NO: 233310 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacttggagagttac

SEQ ID NO: 233311 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacttggacagttac

SEQ ID NO: 233312 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacttaggcagttac

SEQ ID NO: 233313 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaactgggcagttacc

SEQ ID NO: 233314 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacgttggcagttac

SEQ ID NO: 233315 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacctgggcagttac

SEQ ID NO: 233316 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcgataacttgggcagttac

SEQ ID NO: 233317 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttccggtaatcttgggcagttac

SEQ ID NO: 233318 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcactctcggttgacttgggcagttac

SEQ ID NO: 233319 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcactctcggtaaccttgggcagttac

SEQ ID NO: 233320 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagacacttctcggtaacttggcagttac

SEQ ID NO: 233321 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttgagcacttctcggttacttgggcagcttac

SEQ ID NO: 233322 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttatcgcactctcggttaacttgggcagttac

SEQ ID NO: 233323 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaggcacttcatcggtaacttgggcagttac

SEQ ID NO: 233324 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttagctcacttctcggtaacttgggcagttac

SEQ ID NO: 233325 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttagctacttcgtcggtaaccttggcagttac

SEQ ID NO: 233326 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttagcaccttctcggtacttgggcgcagttac

SEQ ID NO: 233327 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttagagcacttctcgttaacttgggcagttac

SEQ ID NO: 233328 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttagacaccttctcggtaacttggcgagttac

SEQ ID NO: 233329 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttacgcacttctcggtaacgttggtcagttac

SEQ ID NO: 233330 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagtcacttctcggtaacttggcaagttac

SEQ ID NO: 233331 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcggtaacttagggcattac

SEQ ID NO: 233332 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcggtaacctgggcagttac

SEQ ID NO: 233333 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcgctacttctcggtacttggcagttac

SEQ ID NO: 233334 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcactttctggataacttgggcagttac

SEQ ID NO: 233335 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcgtaacttgggacagcttac

SEQ ID NO: 233336 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggttaacttgggcagttgc

SEQ ID NO: 233337 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggttaacctgggcagttac

SEQ ID NO: 233338 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaactttgagcagttac

SEQ ID NO: 233339 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttggtcagttacc

SEQ ID NO: 233340 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttgggctagttac

SEQ ID NO: 233341 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttgggccagttgc

SEQ ID NO: 233342 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttgggcagttaac

SEQ ID NO: 233343 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttggctcagttac

SEQ ID NO: 233344 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttggcagttaccc

SEQ ID NO: 233345 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacctgggccagttac

SEQ ID NO: 233346 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacattgggcagttac

SEQ ID NO: 233347 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcgggtaacttgggcagttac

SEQ ID NO: 233348 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggataacttggcagttaac

SEQ ID NO: 233349 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctccgtaacttgggcagttacc

SEQ ID NO: 233350 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttcatcggtaacttgggctattac

SEQ ID NO: 233351 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttcatcggtaactcgggcagttac

SEQ ID NO: 233352 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagacgcacttcttcgtaactcggcattac

SEQ ID NO: 233353 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagacacttctcggtaacttgggcagttac

SEQ ID NO: 233354 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaacgcacttctcggtaacttgggccagtta

SEQ ID NO: 233355 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaacgcacttctcggtaacttgggcagtcac

SEQ ID NO: 233356 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaacgcacttctcggtaacttaggcagttac

SEQ ID NO: 233357 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaaagcactttctgggataccgtggcagtaa

SEQ ID NO: 233358 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaaagcactttctcgggatacttggcagtac

SEQ ID NO: 233359 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaaagcactttctcggatacttggcagttac

SEQ ID NO: 233360 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaaacgcactttctgggatactggcagtacc

SEQ ID NO: 233361 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttatacgcacttctcggtaacttgggcagttac

SEQ ID NO: 233362 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttaaagcactttctgggataccgtgggcagtac

SEQ ID NO: 233363 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcgttttaagcacttctggtaacttgggcagttac

SEQ ID NO: 233364 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcgttttaagcacttctcggtaacttggcagttac

SEQ ID NO: 233365 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggccttttaagcacttctcgtaacttgggcagttac

SEQ ID NO: 233366 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggactttaagctacttctcggtaactgggcagttac

SEQ ID NO: 233367 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggactttaagcacttctcggtaacttgggcagttac

SEQ ID NO: 233368 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcttttaagcacttctcggttaacttgggcagttac

SEQ ID NO: 233369 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcgtttaagcacttctcggtgacttgggccagttac

SEQ ID NO: 233370 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcgtttaagcacttctcggtaacttgggccagttac

SEQ ID NO: 233371 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcggttttaagcacttctggtaacttgggcagttac

SEQ ID NO: 233372 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcgctttaagcacttctcggtaacttgggcagttac

SEQ ID NO: 233373 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcctttagcacttctcgttaacttcggacaacttac

SEQ ID NO: 233374 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggagctttaagcacttctcggtaacttgggcagttac

SEQ ID NO: 233375 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggacttttaagcacttctcggtaacttgggcagttac

SEQ ID NO: 233376 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgcggttttaagcacttctcggtaacttgggcagttac

SEQ ID NO: 233377 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgcgccagtcacatcaactatgatgacgcttgactgga

SEQ ID NO: 233378 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgcgactacgctcttgaacaattctgatccctggattt

SEQ ID NO: 233379 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgcctcgatcctcgcaccgcacgcgatcccaatgtctg

SEQ ID NO: 233380 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgagcttgtctttaatctcggcagaggtgctcatgagc

SEQ ID NO: 233381 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgagctagtctttaatctcggcagagtgctcattgagc

SEQ ID NO: 233382 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcttactggggaagttgtatgtcccttttaacgtaaca

SEQ ID NO: 233383 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcttactgggaagttgatatgtcccttttaacgtaacg

SEQ ID NO: 233384 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcttactgggaagcttgtatgtcccttttaacgtaacg

SEQ ID NO: 233385 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatctctcggctcccgtgcgcacgcagctgactcgaactg

SEQ ID NO: 233386 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatctcgagatcactaggcactatcctagcactgtatcaa

SEQ ID NO: 233387 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcggcactggaggcgtccttggtggactaccaccttat

SEQ ID NO: 233388 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgcctctgttctcgcatgctagcaacattaatgggcg

SEQ ID NO: 233389 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgccagtctacatcaactatgagtgacgctaactgga

SEQ ID NO: 233390 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgccagtcacatcaactatgatgacgcttggactgga

SEQ ID NO: 233391 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgccagtcacatcaactatgactgacgcttgactgga

SEQ ID NO: 233392 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgccagccacatcaactatgatgacgctttgactgga

SEQ ID NO: 233393 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgccagccacatcaactactgatgacgcttactggaa

SEQ ID NO: 233394 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgccagcacatcacttatgactgacgcttgactacga

SEQ ID NO: 233395 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgccacgtcacatcaactatgatgacgctagactgga

SEQ ID NO: 233396 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatccggagctgtctcgtcgtccctgggcccaatacgtag

SEQ ID NO: 233397 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatccgcctcatcatcggacacgactgtatcagttggctg

SEQ ID NO: 233398 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatccgccagccacatcaactatgacgacgcttgactgga

SEQ ID NO: 233399 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcaccagtcacatcaactatgactgacgcttgactgga

SEQ ID NO: 233400 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcacagtaattctgcccctctgatgaaaccggttactt

SEQ ID NO: 233401 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatatgttatattacttgccttgctccaaccctggtatac

SEQ ID NO: 233402 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataggtcgcctggtccgcctcgatcctctataccgtctg

SEQ ID NO: 233403 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatagggcttttaagcacttctggtaacttgggcagttac

SEQ ID NO: 233404 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatagggctttaagcacttctcggtaacttgggcagttac

SEQ ID NO: 233405 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataggcttttaagcacttctcggtaacttgggcagttac

SEQ ID NO: 233406 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatagctataaatcccgccttgatccttccaggctgcagg

SEQ ID NO: 233407 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatagcctgtcttttaatctcggcagagtcgctcatgagc

SEQ ID NO: 233408 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatagatcgttcttatccgcctcggtcttccccaggttaa

SEQ ID NO: 233409 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatacgcctgtacttttcaatctcgcagagtgctcatagc

SEQ ID NO: 233410 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatacaggtgttaattgcctccggtccttccgtgtgcaca

SEQ ID NO: 233411 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataaggcctgtcttttaatctcggcagatgctcatgagc

SEQ ID NO: 233412 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttcaatctcgcagagtgctcatgagc

SEQ ID NO: 233413 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatcttggcagagtgctcatgagc

SEQ ID NO: 233414 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggtagagtgctcatgagc

SEQ ID NO: 233415 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggctgagtgctcatgagc

SEQ ID NO: 233416 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcggagtgcttatgagc

SEQ ID NO: 233417 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggccgagtgctcatgagc

SEQ ID NO: 233418 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagagtgttcatgagc

SEQ ID NO: 233419 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagagtgcttatgagc

SEQ ID NO: 233420 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagagtgctcttgagc

SEQ ID NO: 233421 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagagtgctcatgatc

SEQ ID NO: 233422 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagagtgctcatgagg

SEQ ID NO: 233423 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagagtgctcatgaac

SEQ ID NO: 233424 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagagtgctcacgagc

SEQ ID NO: 233425 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagagtgcccatgagc

SEQ ID NO: 233426 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagagtgcacatgagc

SEQ ID NO: 233427 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcaagtgtgctctgagc

SEQ ID NO: 233428 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcaagtagctcatgagc

SEQ ID NO: 233429 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcagcagagtgctcatgagc

SEQ ID NO: 233430 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtctttaatctcggtcagagtgctcatgagc

SEQ ID NO: 233431 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtctttaatctcggcagagtgctcatgagcc

SEQ ID NO: 233432 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttctaatctcggcagagtgctcatgagc

SEQ ID NO: 233433 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtctcttaatcttggcagagtgctcatgagc

SEQ ID NO: 233434 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtctcttaatctcggcagagtgctcatgagc

SEQ ID NO: 233435 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtattttaatctcggcagagtgctcatgagc

SEQ ID NO: 233436 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagccagccacatcagctatgatgacgcttgactgga

SEQ ID NO: 233437 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcagcaccatgctaatagcatggcccccttaactg

SEQ ID NO: 233438 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataaacctgtcttttaatctcggcagagtgctcatgagc

SEQ ID NO: 233439 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtgttatggcgatcggattgccctcaccctgaccgctg

SEQ ID NO: 233440 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgtatccgtactttcaggcgttagcctatcacccga

SEQ ID NO: 233441 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgccagtcacatcaactatgatgacgcttggctgga

SEQ ID NO: 233442 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgatctgtactttcaggcgctatcctgatcacccga

SEQ ID NO: 233443 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgatccgtactttcaggcgctgtcctgatcacccga

SEQ ID NO: 233444 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgatccgtactttcaggcgctaccctgatcacccga

SEQ ID NO: 233445 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgatccgtactttcaggcgatatcctgatcacccga

SEQ ID NO: 233446 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgatccgtacttcaggtcgctatcctgatcacccga

SEQ ID NO: 233447 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgatccgtaccttcaggcgctatcctgatcacccga

SEQ ID NO: 233448 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgactccgtagcttcagcgctatcctgatcacccga

SEQ ID NO: 233449 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtccgtaactttcaagcactatcttgatcaaatgtgga

SEQ ID NO: 233450 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtccgatccgtactttcaggcgctatctgatcacccga

SEQ ID NO: 233451 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taggttcctcgaaccgcctcgcctcgtgtacagtactgca

SEQ ID NO: 233452 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagggtatccatgaaggactaccttcttattggagacttg

SEQ ID NO: 233453 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagggtacgatgaggagacccaatcgcccctctgtgcgcg

SEQ ID NO: 233454 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taggggcttttaagcacttctcggtaacttgagcagttac

SEQ ID NO: 233455 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taggcgttttaagctacttctcggtaacttgggcagttac

SEQ ID NO: 233456 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taggcggttttaagcacttctcggtaacttgggcagtcac

SEQ ID NO: 233457 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taggatgcgccttgctccgctatacgacgtccagtcgctg

SEQ ID NO: 233458 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taggaaataactcggccctcctcctgctaccgcttgcagc

SEQ ID NO: 233459 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagcttaccccatcgagctagtctacgtctccatcaacgg

SEQ ID NO: 233460 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagcttaccccatcgagcgagtctacgtctccatcaacgg

SEQ ID NO: 233461 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagctaccccatcgagcgagtctacgtctccatcaacggg

SEQ ID NO: 233462 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagcctcgatcctctcatgcgcgcgcatcggttttgggcc

SEQ ID NO: 233463 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagccgcttctcatcggacacgacgtgtatcagttggctg

SEQ ID NO: 233464 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagccgcttcatcatcggacacgacgtgtatcagtggctg

SEQ ID NO: 233465 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagccgcttcatcatcggacacgacgtgtatcagctgctg

SEQ ID NO: 233466 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagatctcggatctggcgtactacttggacaggttccttc

SEQ ID NO: 233467 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagagttcacgtcgcgattgcagctgatatcctccctacg

SEQ ID NO: 233468 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagaacagagattcggtccgccttgcgcctcctgagagta

SEQ ID NO: 233469 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactttgcgtaactacagcctctgtcctccaaatgctggc

SEQ ID NO: 233470 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacttcgccatctctccactcgcgtcgactcaattcggag

SEQ ID NO: 233471 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactgcctccatcatcggacacgacgtgtatcagttgctg

SEQ ID NO: 233472 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactgaggccctcgtgttggactaccaacttgtagaacgg

SEQ ID NO: 233473 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactcgccagtcacatcaactatgatgacgcttgactaga

SEQ ID NO: 233474 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactcgccagtcacatcaactacgatgacgcttgactgga

SEQ ID NO: 233475 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactcctcctttttcggatcacgttgttttcccctgtgca

SEQ ID NO: 233476 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatcctcatcgatgctgagttattcgcctacgagggg

SEQ ID NO: 233477 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttgtccgtcctcctgtggtattgcgcatgc

SEQ ID NO: 233478 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttggccgtcctcttgtggtattgcgcatgc

SEQ ID NO: 233479 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgttcgtccgtcctcttgtggtattgcgcatgc

SEQ ID NO: 233480 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtatcgagcgttgtcaacaagcggttaaggcc

SEQ ID NO: 233481 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtatcgagcgttgtcaacaagcggctaaggcc

SEQ ID NO: 233482 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactacccctatcgagcgagtctactctcccatcaacggg

SEQ ID NO: 233483 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactacccccatcgagcgggtctactctcccatcaacggg

SEQ ID NO: 233484 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactacccccatcgagcgagtctactctcccgtcaacggg

SEQ ID NO: 233485 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactacccccatcgagcgagtctactctcccatcagcggg

SEQ ID NO: 233486 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactacccccatcgagcgagcctactctcccatcaacggg

SEQ ID NO: 233487 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacgttctcggatctttaaatatcggcaaagtcctcctga

SEQ ID NO: 233488 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacgtaacgccttggaatgcaacgttgcatattttccccg

SEQ ID NO: 233489 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacggggctttaaagcactttctcgggtactggcagttac

SEQ ID NO: 233490 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacgcctcattcatcggacacgacgtgtatcagttggctg

SEQ ID NO: 233491 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacctctaccgcctcgtaagcccgggcacttacctctgta

SEQ ID NO: 233492 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacctagaggctaactccggtagcaaccgatcgtatgaaa

SEQ ID NO: 233493 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgtctcgtcatcggacacgacgtgtatcagttggctg

SEQ ID NO: 233494 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgtctcgaaattaccctcttctcggatatttagtgca

SEQ ID NO: 233495 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgtctcatcatcggacacgacgtgtatcagttggcta

SEQ ID NO: 233496 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccggcctcatcatcggcacgacgtgtatcagttggctg

SEQ ID NO: 233497 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccggcattggaggcgtccttggtggactaccaccttgt

SEQ ID NO: 233498 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccggcattggaggcgtccttggtggactaccaccttat

SEQ ID NO: 233499 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccggcactggaggcgtccttggtggattaccaccttat

SEQ ID NO: 233500 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccggcactggaggcgtccttggtagactaccaccttat

SEQ ID NO: 233501 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccggaacgcctcgatcctcgcataatatgatacgtctg

SEQ ID NO: 233502 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgctcactcatcggacacgacgtgtatcagttgctga

SEQ ID NO: 233503 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgctacatcatcggacacgacgtgtatcagctggctg

SEQ ID NO: 233504 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctttggtccagttttacgtgaaaacttttatctg

SEQ ID NO: 233505 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgccttggcatgtaagcttacagattttcttccctga

SEQ ID NO: 233506 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcttcatcggacacgacgtgtatcagttggctg

SEQ ID NO: 233507 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctctacatcggacacgacgtgtatcagttggctg

SEQ ID NO: 233508 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcctcatcggacacgacgtgtatcagttggctg

SEQ ID NO: 233509 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatctatcggacactacgtcgattcagtgctg

SEQ ID NO: 233510 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatctatcggacacgacgtcgtatcagtgctg

SEQ ID NO: 233511 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcgtacacgacgtgtatcagttggctg

SEQ ID NO: 233512 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggagacgacgtgtatcagttggctg

SEQ ID NO: 233513 - skipped

SEQ ID NO: 233514 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacccgacgtgtatcagttggctg

SEQ ID NO: 233515 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacaggacgtgtatcagttggctg

SEQ ID NO: 233516 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgtcgtgtatcagttggctg

SEQ ID NO: 233517 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgaggtgtatcagttggctg

SEQ ID NO: 233518 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgactgtatcagtgtcgctg

SEQ ID NO: 233519 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtgtcagtcggctg

SEQ ID NO: 233520 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatctgttggctg

SEQ ID NO: 233521 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatctgttggccg

SEQ ID NO: 233522 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatcatggtgctg

SEQ ID NO: 233523 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatcagttggatg

SEQ ID NO: 233524 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatcagttgcctg

SEQ ID NO: 233525 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatcagttagctg

SEQ ID NO: 233526 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatcagttaactg

SEQ ID NO: 233527 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatcagtgggctg

SEQ ID NO: 233528 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatcagtcggcta

SEQ ID NO: 233529 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatcaatgtgctg

SEQ ID NO: 233530 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtaacagtggtctg

SEQ ID NO: 233531 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtatatcagttggctg

SEQ ID NO: 233532 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgatgtcatgtgtgctg

SEQ ID NO: 233533 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacatgtatcagttggctg

SEQ ID NO: 233534 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgaagtgtatcagttggctg

SEQ ID NO: 233535 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcataggacatgacgtgtatcagttggctg

SEQ ID NO: 233536 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcataggacacgacgtgtatcagttggctg

SEQ ID NO: 233537 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcataatcggacacgacgtgtatcagttggctg

SEQ ID NO: 233538 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcactcatcggacacgacgtgtatcagtgcgtg

SEQ ID NO: 233539 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcacgtcatcggacatcgacgtgatcagtgctg

SEQ ID NO: 233540 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcaccatcggacatcgacgtgtatcagttgctg

SEQ ID NO: 233541 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctacatcatcggacacgacgtgtatcagttgctg

SEQ ID NO: 233542 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgccgcatcatcggacacgacgcgtatcagttggctg

SEQ ID NO: 233543 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgccctcatatcggacacgacgtgtatcagttggctg

SEQ ID NO: 233544 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcccactcatcggacacgacgtgtatcagttggctg

SEQ ID NO: 233545 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcatcatcatcggacacgacgtgtatcagttggctg

SEQ ID NO: 233546 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacccgctcatcatcggacacgacgtgtatcagttggctg

SEQ ID NO: 233547 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacccctgatgtcgacgtcacgcttatctaaatcgtcaaa

SEQ ID NO: 233548 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacagcctcccttgcgcgcaaaatgttcccctcgtgtggc

SEQ ID NO: 233549 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacagcctcatcatcggacacgacgtgtatcagttggctg

SEQ ID NO: 233550 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacagaggccctcgtgttggactaccagcttgtagaacgg

SEQ ID NO: 233551 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacagaggccctcgtgttggactaccaacttgtagggcgg

SEQ ID NO: 233552 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacagaggccctcgtgttggactaccaacttgtaggacgg

SEQ ID NO: 233553 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacagaggccctcgtgttggactaccaacttgtagaacga

SEQ ID NO: 233554 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacagaggccctcgtgctggactaccaacttgtagaacgg

SEQ ID NO: 233555 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacagaagccctcgtgttggactaccaacttgtagaacgg

SEQ ID NO: 233556 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacacaggtgttaattgcctccggtccttccgcgtgcaca

SEQ ID NO: 233557 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacaagcctgtcttttaacctcggcagagtgctcatgagc

SEQ ID NO: 233558 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taatttcccgataccgccttgtatctgtgcctgtcgcact

SEQ ID NO: 233559 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taattcgccagtcacatcaactatgatgacgcttggctga

SEQ ID NO: 233560 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taatgggcttttaagcacttctcggtaacttggcagttac

SEQ ID NO: 233561 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taatgggctttaagcacttctcggtaacttgggcagttac

SEQ ID NO: 233562 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taatgcttgatctcctgtcgactctgcggctgagactact

SEQ ID NO: 233563 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taatctggtacctatcatgtgctatcatgacggctaggac

SEQ ID NO: 233564 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taatctggtacctatcatgcgctaccatgacggctaggac

SEQ ID NO: 233565 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taatcgatccgtactttcaggcgctatcctgatcacccga

SEQ ID NO: 233566 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaggggctttaagcacttctcggtaacttgggcagttac

SEQ ID NO: 233567 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taagcctcgatcctcgcaccgcacgcgatcccaatgtctg

SEQ ID NO: 233568 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taagccggggcctgcctcaagctagctacctccattgctg

SEQ ID NO: 233569 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taagagtgcacagtattgcctcgatcctccatggcttaag

SEQ ID NO: 233570 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taagagtgcacagtactgcctcgatcctgcatggcttaag

SEQ ID NO: 233571 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taagagtgcacagtactgcctcgatcctccatggcttagg

SEQ ID NO: 233572 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taagagtgcacagtactgcctcgatcctccatggctcaag

SEQ ID NO: 233573 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taagagtgcacagtactgcctcgatcctccatagcttaag

SEQ ID NO: 233574 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taagagtgcacagtactgcctcgatcccccatggcttaag

SEQ ID NO: 233575 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taagagtgcacagtaccgcctcgatcctccatggcttaag

SEQ ID NO: 233576 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taacttgcgtgcttaggtacctggtcactcctgcacgggt

SEQ ID NO: 233577 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taacttgcgtgcttaggtacctggtcactcctgcacgggg

SEQ ID NO: 233578 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taacgggcccctttatccacctcgcttctccccgactgcg

SEQ ID NO: 233579 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaccggggcccgcctcaagctagctacctccattggctg

SEQ ID NO: 233580 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaattgggccctgattacgcctcggtccttgcgttaccg

SEQ ID NO: 233581 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaattgggccctgattacgcctcggtcctcgcattaccg

SEQ ID NO: 233582 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaagtccgcggtttcactagactactactgatcacgtcg

SEQ ID NO: 233583 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtttcagaactcgcccctctggagtaataggccgaatttc

SEQ ID NO: 233584 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtttactcgggtccattcgcctcggtctccccattaggta

SEQ ID NO: 233585 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtttaattgcttccttttggcgctatccattcgatggcag

SEQ ID NO: 233586 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtttaagcgctaccagctaattagcatggccccttaactg

SEQ ID NO: 233587 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttgggaagcggaactggtcgaggcgctatcctcgactta

SEQ ID NO: 233588 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttgacatctgttcgttggttaaccataaccattttagtg

SEQ ID NO: 233589 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctgcgctctgtcctcatggttcgaaccggtatgcatg

SEQ ID NO: 233590 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgctctgtcctcatggttcgaaccggtatcgcatg

SEQ ID NO: 233591 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctttgtcctcatggttcgaaccggtatgcatg

SEQ ID NO: 233592 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgttctcatggttcgaaccggtatgcatg

SEQ ID NO: 233593 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcttcatggttcgaaccggtatgcatg

SEQ ID NO: 233594 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcttggttcgaaccggtatgcatg

SEQ ID NO: 233595 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatgtttcgaaccggtatgcatg

SEQ ID NO: 233596 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatgttcgaaccggtatcgcatg

SEQ ID NO: 233597 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatgttcgaaccggtatccgatg

SEQ ID NO: 233598 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatgttcgaaccggtagtgcatg

SEQ ID NO: 233599 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggtttgaaccggtatgcatg

SEQ ID NO: 233600 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggttcggaccggtatgcatg

SEQ ID NO: 233601 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggttcgaaccggtttgcatg

SEQ ID NO: 233602 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggttcgaaccggtatgcacg

SEQ ID NO: 233603 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggttcgaaccggtatgaatg

SEQ ID NO: 233604 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggttcgaaccggtatacatg

SEQ ID NO: 233605 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggttcgaaccgggatgcatg

SEQ ID NO: 233606 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggttcgaacccgtatgcatg

SEQ ID NO: 233607 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggttcgaaccagtatgcaag

SEQ ID NO: 233608 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggttcaaaccggtatgcatg

SEQ ID NO: 233609 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggctcgaaccggtatgcatg

SEQ ID NO: 233610 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatgattcgaaccggtatgcatg

SEQ ID NO: 233611 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatagttcgaaccggtatgcatg

SEQ ID NO: 233612 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcacgtcgatccggtaacgtgatg

SEQ ID NO: 233613 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtccctctggttcgaaccggtatgcatg

SEQ ID NO: 233614 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctccgtctccatggttcgaaccggtatgcatg

SEQ ID NO: 233615 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctactgtcctcatgttcgaaccggtatgcatg

SEQ ID NO: 233616 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgccgctgtcctcatggttcgaaccggtatgcatg

SEQ ID NO: 233617 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcccctgtcctcatggttcgagccggtatgcatg

SEQ ID NO: 233618 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgccactgtcctcatggttcgaaccggtatgcatg

SEQ ID NO: 233619 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctccacacgggattgttcagttatgccaaggtagaac

SEQ ID NO: 233620 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctagcctctgtcctcatggttcgaaccggtatgcatg

SEQ ID NO: 233621 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttcgtagttttttgactacaaaaatattacacgaacaga

SEQ ID NO: 233622 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttcctcgctctgtcctcatggttcgaaccggtatgcatg

SEQ ID NO: 233623 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttcatcgcctctgtcctcatggttcgaaccgtatgcatg

SEQ ID NO: 233624 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttcatcgcatcacatcaactatgatgacgcttgactgga

SEQ ID NO: 233625 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttcacgctgccctttgtttaaggactttatacaaacgca

SEQ ID NO: 233626 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttcacgcctctgtcctccatggttgaaccggtatgcatg

SEQ ID NO: 233627 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttatcgcctctgtcctcatggttcgaaccggtatgcatg

SEQ ID NO: 233628 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttaggctttcacgcacgcggattgtacccgaactgggtt

SEQ ID NO: 233629 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttaggcttcacgcacgcggatttgtacccgaactgggtt

SEQ ID NO: 233630 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttaccgctgggtgaggagtcgttgtgcgctatcacatct

SEQ ID NO: 233631 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttaacggtacagatgcttccgcctaggttcctcctgtcg

SEQ ID NO: 233632 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgtaatcgattcgctgcgcctcggtccaaccatgcgctg

SEQ ID NO: 233633 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtggtggttttctcggattccctccctgccactcgtgatg

SEQ ID NO: 233634 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtggtcccatgagcttctggcactatccagttgacgctca

SEQ ID NO: 233635 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtggtccatgagtcttctggcactatccagttgacgctca

SEQ ID NO: 233636 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtggtccatgagccttctggcactatccagttgacgctca

SEQ ID NO: 233637 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtggggcttttaagcacttctcggtaacttgggcagttac

SEQ ID NO: 233638 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtggcatcctgttcgcttcggcgctatccgattgaccgaa

SEQ ID NO: 233639 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgcgtgttctgccttctaaagactactttagtgcaaagc

SEQ ID NO: 233640 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgcggaacgcctcgatcctcgcataatatgatacgtctg

SEQ ID NO: 233641 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgcgaacctcctcctacccgccttgaaccgctgttgcaa

SEQ ID NO: 233642 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgatgtagcccactatggctttgttcgatcattgctccg

SEQ ID NO: 233643 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgatgtagcccactatggcctttgttcgatcatgctccg

SEQ ID NO: 233644 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgatggccacgatgcactatcctcgattacggtcatcgc

SEQ ID NO: 233645 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgatcatataaagccggcctgctcgcctcggtcctccat

SEQ ID NO: 233646 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgatatcacgtgcctgggttccaaccattcgagcttaag

SEQ ID NO: 233647 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgagaagcgtgtgagagactactctgtttgtaacgcgat

SEQ ID NO: 233648 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgacccgctcagctatcggcaccgtactcatacgtgctg

SEQ ID NO: 233649 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgacaatcagaccacgacctcgggcagcattatgttttg

SEQ ID NO: 233650 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgaatcacgtgagcactcgcctcgcaatctgcgtcaggc

SEQ ID NO: 233651 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgaagtcgaaccgcctcgatcctcttcgtccacgtcctc

SEQ ID NO: 233652 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgaagtcgaaccgccacgatcctcttcgtccacgtcctc

SEQ ID NO: 233653 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtctcttacgcgcaggacgtctttcgtgcactatcacgat

SEQ ID NO: 233654 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtctcgggtccgttgtttaccgcttcgcaccggcccagta

SEQ ID NO: 233655 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtctattcgccgaggacgtctttcgtgcactatcacgatt

SEQ ID NO: 233656 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtctatggtacgcctcgattccgcccatacatgcatgtaa

SEQ ID NO: 233657 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgttggatatacttgcgcaattacatcagaggggtctg

SEQ ID NO: 233658 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccacctgacatcgcgggggaactaatggtt

SEQ ID NO: 233659 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctggcatcgcggggaactaatggtt

SEQ ID NO: 233660 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgagcatcgcggggaactaatgtt

SEQ ID NO: 233661 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacgtcacggggaactaatggtt

SEQ ID NO: 233662 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacctcgcggggaactaatggtt

SEQ ID NO: 233663 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacatcgcggggaactgatggtt

SEQ ID NO: 233664 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacatcgcggggaactaatggtg

SEQ ID NO: 233665 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacatcgcggggaactaatggtc

SEQ ID NO: 233666 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacatcgcggggaaccaatggtt

SEQ ID NO: 233667 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacatcgcagggaactaatggtt

SEQ ID NO: 233668 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacaccgcggggaaccaatggtt

SEQ ID NO: 233669 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttacaccctgacatcgcggggggactaatggtt

SEQ ID NO: 233670 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtactcaccaccctgacatcgcggggaactaatggtt

SEQ ID NO: 233671 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtactacctacctgacatcgcggggaactaaatggtt

SEQ ID NO: 233672 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtaattaccaccctgacatcgcggggaactaatggtt

SEQ ID NO: 233673 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcggttcttctctgactacatgagattataaacgcgtgc

SEQ ID NO: 233674 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcggttcttctcctgactacatgagattaataaacgcgc

SEQ ID NO: 233675 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcggaacgcctcgatcctcgcataattatgatacgtctg

SEQ ID NO: 233676 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcggaacgcctacgatcctcgcataatatgatacgtctg

SEQ ID NO: 233677 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgccacctcggatctgaccgcaatatcatgatatgtca

SEQ ID NO: 233678 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgcacttaccaccctgacatcgcggggaactaatggtt

SEQ ID NO: 233679 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgcacttaccaccctgacaccgcggggaactaatggtt

SEQ ID NO: 233680 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgatacttaccacctgacatcgcggggaactaatggtt

SEQ ID NO: 233681 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgacctgcgttctctcggccacttatcgattgacgctg

SEQ ID NO: 233682 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgaccgcctcgatcctctggacactatgatacgtgctg

SEQ ID NO: 233683 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgaatcgcctcgatctcgcataatatgatacgttctgg

SEQ ID NO: 233684 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgaatcgcctcgactcctcgcataatatgatacgtctg

SEQ ID NO: 233685 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgaagcgccttcgatctcgcataatatgattacgtctg

SEQ ID NO: 233686 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgaacgccttcgatcctcgcataatagtgatacgtctg

SEQ ID NO: 233687 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgaacgcctcgattcctcgcataatatgatacgtcctg

SEQ ID NO: 233688 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgaacgcctcgatcctcgacataatatgatacgttctg

SEQ ID NO: 233689 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccttggtacgcctcgattccgcccatacatgcatgtaa

SEQ ID NO: 233690 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcctcgcctcagtcctcatggttcgaaccggtatgcatg

SEQ ID NO: 233691 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgtcgtcccgttttagatgttacgttgaatctcgttc

SEQ ID NO: 233692 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgtcatgttcccgcctgggttcctcctgataagcatg

SEQ ID NO: 233693 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggtacgcctcgatcctcgcataatatgatacgtctg

SEQ ID NO: 233694 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggggcgcctcgatcctcgcataatatgatacgtctg

SEQ ID NO: 233695 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgggacgcctcggtcctcgcataatatgatacgtctg

SEQ ID NO: 233696 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgggacgcctcgatcctcgcataatatggtacgtctg

SEQ ID NO: 233697 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgggacgcctcgatcctcgcataatacgatacgtccg

SEQ ID NO: 233698 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgggacgcctcgatcctcgcataataagatacgtctg

SEQ ID NO: 233699 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggatcgcctcgatcctcgcataatatgatacgtctg

SEQ ID NO: 233700 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggagcgctcgatcctcgcataatatggtacgtcctg

SEQ ID NO: 233701 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggagcgcctcgatccttgcataatatgatacgtctg

SEQ ID NO: 233702 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggagcgcctcgatcctcgcatagtatgatacgtctg

SEQ ID NO: 233703 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggagcgcctcgatcctcgcataatatgacacgtctg

SEQ ID NO: 233704 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggagcgcctcgatcctcgcataatacgatacgtctg

SEQ ID NO: 233705 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggagcgcctcgatcctcgcataacatgatacttctg

SEQ ID NO: 233706 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggagcgcctcgatccccgcataatatgatacgtctg

SEQ ID NO: 233707 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggagactactccgttggtctgcaggtgtcaccacga

SEQ ID NO: 233708 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaccgcctcgatcctcgcataatatgatacgtctg

SEQ ID NO: 233709 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaatcgcctcgatctcgcataatatgatacgtctg

SEQ ID NO: 233710 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaatcgcctcgatcctcgcatatatgatacgtctg

SEQ ID NO: 233711 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaagtccctcctcgtcttgatgcactatcatctca

SEQ ID NO: 233712 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaaggccccgatcctcgcattatatgatacgtctg

SEQ ID NO: 233713 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaagcgctcgatcctcgcataatatgatacgtctg

SEQ ID NO: 233714 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaagcgcctcgatctcgcataatatgatacgtctg

SEQ ID NO: 233715 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgtctcgatcctcgcataatatgatacgtcgg

SEQ ID NO: 233716 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgccttgatcctcgtataatatgatacgtctg

SEQ ID NO: 233717 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgccttgatcctcgcataatatgatacatctg

SEQ ID NO: 233718 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctctatcctcgcataatatgatacgtctg

SEQ ID NO: 233719 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgtatcctcgcatatatgatacgtctg

SEQ ID NO: 233720 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcggtcctcgcataacatgatacgtctg

SEQ ID NO: 233721 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcggtcctcacataatatgatacgtctg

SEQ ID NO: 233722 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcttcgcataatatgatacgtctg

SEQ ID NO: 233723 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcgtaatatgatgcgtctg

SEQ ID NO: 233724 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcgtaatataatacgtctg

SEQ ID NO: 233725 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcatgatacgatacgtctg

SEQ ID NO: 233726 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcatatatggatacgtctg

SEQ ID NO: 233727 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcatatatgattacgtctg

SEQ ID NO: 233728 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcatatatgatacgtctgc

SEQ ID NO: 233729 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcatatatcgatacgcctg

SEQ ID NO: 233730 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcatagtataatacgtctg

SEQ ID NO: 233731 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcatagcatgatacgtctg

SEQ ID NO: 233732 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcatactgtgatacgtctg

SEQ ID NO: 233733 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcatactatgatacgtctg

SEQ ID NO: 233734 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatttgatacgtctg

SEQ ID NO: 233735 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatgtgatacgcctg

SEQ ID NO: 233736 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatgtgacacgtctg

SEQ ID NO: 233737 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatggtacgtcta

SEQ ID NO: 233738 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatggcacgtctg

SEQ ID NO: 233739 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgatacgtgtg

SEQ ID NO: 233740 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgatacgtctt

SEQ ID NO: 233741 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgatacgtctc

SEQ ID NO: 233742 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgatacgtatg

SEQ ID NO: 233743 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgatacggctg

SEQ ID NO: 233744 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgatacggccg

SEQ ID NO: 233745 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgacacgtttg

SEQ ID NO: 233746 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgaaacgtctg

SEQ ID NO: 233747 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatcgatacgctg

SEQ ID NO: 233748 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatcatacgtctg

SEQ ID NO: 233749 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatacgacacgtctg

SEQ ID NO: 233750 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataacaggatacgtctg

SEQ ID NO: 233751 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcacaatatgatgcgtctg

SEQ ID NO: 233752 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcacaatatgataggtctg

SEQ ID NO: 233753 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcaatatatgatacgtctg

SEQ ID NO: 233754 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctccgcatatatgatacgtctg

SEQ ID NO: 233755 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcacctaatatgatacgtctg

SEQ ID NO: 233756 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcacatagtatgatacgtctg

SEQ ID NO: 233757 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcacacaatatgatacgtctg

SEQ ID NO: 233758 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctagcataatatgatacttctg

SEQ ID NO: 233759 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatccacgcataatatgatatgtctg

SEQ ID NO: 233760 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgagcctcgcataatatgatacgtctg

SEQ ID NO: 233761 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgactcctcgcatatatgatacgtctg

SEQ ID NO: 233762 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcagtcctcgcattatatgatacgtctg

SEQ ID NO: 233763 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgccctcgatcctcgcatatatgatagtgctg

SEQ ID NO: 233764 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgccccgatcctcgcataatataatacgtctg

SEQ ID NO: 233765 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgccacgatcctcgcataatatgatacgtctg

SEQ ID NO: 233766 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcatcgatcctcgcataatatgatacgtctg

SEQ ID NO: 233767 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaaccgctcgatcctcgcataatatgatacgtctg

SEQ ID NO: 233768 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgcctccgaagccctcctaagtgcactttaaaccgcg

SEQ ID NO: 233769 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgatgtacgcctcgattccgcccatacatgcatgtaa

SEQ ID NO: 233770 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaagcgccttcgatctcgcataatatgatacgtctg

SEQ ID NO: 233771 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaagccgctcgatcctcgcataatatgatacgtctg

SEQ ID NO: 233772 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaagacgcctcgatcctcgcacatatgatacgtctg

SEQ ID NO: 233773 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgccttcgatcctcgcataatatgatacgtctg

SEQ ID NO: 233774 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgcctcgattcctcgcatatatggatacgtctg

SEQ ID NO: 233775 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgcctcgattcctcgcataatatgatacgtcag

SEQ ID NO: 233776 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgcctcgatcctcgcatgatatcgatacgtctg

SEQ ID NO: 233777 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgcctcgatcctcgcataatatgcatacgtctg

SEQ ID NO: 233778 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgcctcgatcctcgcataatatgatacgtctgg

SEQ ID NO: 233779 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgcctcgatcctcgcataatatgatacgtcctg

SEQ ID NO: 233780 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgcctcgatcctcgcataatatcgacacgtctg

SEQ ID NO: 233781 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgcctcgatcctcgcataatagtgatacgtctg

SEQ ID NO: 233782 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgcctcgatcctccgcataatatgatacgtctg

SEQ ID NO: 233783 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgcctcgatcctccgcataatatgacacgtctg

SEQ ID NO: 233784 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgcctcgacttcctcgcatatatgatacgtctg

SEQ ID NO: 233785 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgccctcgatcctcgcataatatgatacgtctg

SEQ ID NO: 233786 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaaccgcctcgatcctcgcataatatgatacgtctg

SEQ ID NO: 233787 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtgctgcctcgattccgccatacatgcatgtaa

SEQ ID NO: 233788 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtgcgcctcgattccacccatacatgcatgtaa

SEQ ID NO: 233789 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtatgcctcgattccgcccatacatgcatgtaa

SEQ ID NO: 233790 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtagcctcgattccgcccatacatgcatgtaaa

SEQ ID NO: 233791 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgtctcgattccgcccgtacatgcatgtaa

SEQ ID NO: 233792 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgctccgattccgcccatacatgcatgtaa

SEQ ID NO: 233793 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgccttgattccgcccatacatgcatataa

SEQ ID NO: 233794 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgccttcgattccgcccatacatgcatgta

SEQ ID NO: 233795 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgccttcgattccgccatacgtgcatgtaa

SEQ ID NO: 233796 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgccttcgattccgccatacatgcatgtaa

SEQ ID NO: 233797 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctggattccgcccatacatgcatgtaa

SEQ ID NO: 233798 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctctattccgcccatacatgcatgtaa

SEQ ID NO: 233799 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgtattccgcccatacatgctgtaa

SEQ ID NO: 233800 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattcggcccatacatgcatgtaa

SEQ ID NO: 233801 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattcgccccatacatgcatgtaa

SEQ ID NO: 233802 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccggccatacatgcatgtaa

SEQ ID NO: 233803 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgctcatacatgcatgtga

SEQ ID NO: 233804 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcctatatatgcatgtaa

SEQ ID NO: 233805 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcctatacatgcgtgtaa

SEQ ID NO: 233806 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgccgatacatgcatgtaa

SEQ ID NO: 233807 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatgcatgcatgtga

SEQ ID NO: 233808 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatgcatgcatgcaa

SEQ ID NO: 233809 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatgcatgcatgaaa

SEQ ID NO: 233810 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatatatgcatgtaa

SEQ ID NO: 233811 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacttgcatgtaa

SEQ ID NO: 233812 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacgtgcatgcaa

SEQ ID NO: 233813 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacgtgcacgtaa

SEQ ID NO: 233814 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatggatgtaa

SEQ ID NO: 233815 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatgcttgtaa

SEQ ID NO: 233816 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatgcatgtta

SEQ ID NO: 233817 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatgactgtaa

SEQ ID NO: 233818 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccataaatgcatgtaa

SEQ ID NO: 233819 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccagacatgcatgtaa

SEQ ID NO: 233820 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccacacatgcatgtag

SEQ ID NO: 233821 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgccatacatgcatgtcga

SEQ ID NO: 233822 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgccatacatgcatgtacg

SEQ ID NO: 233823 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgccatacatgcatgtaaa

SEQ ID NO: 233824 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgccatacatgcactgtaa

SEQ ID NO: 233825 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgccataacatgcatgtaa

SEQ ID NO: 233826 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcacatacatgcatgtaa

SEQ ID NO: 233827 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattcccgccatacatgcatgtaa

SEQ ID NO: 233828 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgatgccgcccatacatgcatgtaa

SEQ ID NO: 233829 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgatcccgcccatacatgcatgcaa

SEQ ID NO: 233830 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgatcccgcccacacatgcatgtaa

SEQ ID NO: 233831 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgagtccgcccatacatgcatgtaa

SEQ ID NO: 233832 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgactccgcccatacatgcatgtag

SEQ ID NO: 233833 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgaattccgccatacatgcatgtaa

SEQ ID NO: 233834 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcaagctagctacctccattgtcgtg

SEQ ID NO: 233835 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcaactccgcccatacatgcatgtaa

SEQ ID NO: 233836 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctagattccgcccatacatgcatgtaa

SEQ ID NO: 233837 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctacgattccgccatacatgcatgtaa

SEQ ID NO: 233838 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgccctcaagctagctacctccattgtctg

SEQ ID NO: 233839 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcccgattccgcccatacatgcatgtaaa

SEQ ID NO: 233840 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgccccgattccgcccatacgtgcatgtaa

SEQ ID NO: 233841 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgccacgattccgcccatacatgcatgtaa

SEQ ID NO: 233842 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtaccgcctcgattccgccatacatgcatgtaa

SEQ ID NO: 233843 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatgggtacgcctcgattccgccatacatgcatgtaa

SEQ ID NO: 233844 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggcacgcctcgattccgcccatacatacatgtaa

SEQ ID NO: 233845 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggaacgcctcgattccgcccatacatgcgtgtaa

SEQ ID NO: 233846 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatagtacgcctcgattccgctcatacatgcatgtaa

SEQ ID NO: 233847 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccataatacgcctcgattccgcccatacatgcatgtaa

SEQ ID NO: 233848 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccagggtacgcctcgattccgcccatacatgcatgtaa

SEQ ID NO: 233849 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccacggtacgcctcgattccgcccatgcatgcatgtaa

SEQ ID NO: 233850 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccacggtacgcctcgattccgccatacatgacatgtaa

SEQ ID NO: 233851 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccacgctgccctttgtttaaggcctttatacaaacgca

SEQ ID NO: 233852 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccacagtacgcctcgattccgcccatacatgcatgtaa

SEQ ID NO: 233853 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccaatggtacgcctcgattccgccatacatgcatgtaa

SEQ ID NO: 233854 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcatggtacgcctcgattccgccatcacatgcatgtaac

SEQ ID NO: 233855 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcatggggctttagcacttctcgtaacttgggcagttac

SEQ ID NO: 233856 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcatgggctttaagcacttctcgtaacttggacagttac

SEQ ID NO: 233857 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcatgggctttaagcacttctcggtaacttggcagttac

SEQ ID NO: 233858 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcatgatggagaaatgaatcactatattcttgtacgctc

SEQ ID NO: 233859 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcatgacgcctcgactcctcgcataatatgatacgtctg

SEQ ID NO: 233860 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcagtgttcttcgcgctgcgctatcaccgaccagatgaa

SEQ ID NO: 233861 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcagtccttccccgtctcgaactcatgtgcatgcatgcc

SEQ ID NO: 233862 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcagtcctccgtcttgtggatgcgtgtttgattctcgtc

SEQ ID NO: 233863 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcacttctcggatcatgaaaaaatacgtacccgtcatcc

SEQ ID NO: 233864 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcaatggtacgcctcgattccgcccgtacatgcatgtaa

SEQ ID NO: 233865 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcaatggcccattcccgctccgattatcgctagtacgtt

SEQ ID NO: 233866 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcaaatgggccctgattcacgcctacgtcttgcataccg

SEQ ID NO: 233867 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatggggcttttagacacttcgtcgacttgggcagttac

SEQ ID NO: 233868 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatggggctttagcacttctcggtaacttgggcagttac

SEQ ID NO: 233869 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatggggcgtttaagctactctcgtaacttaggcatgac

SEQ ID NO: 233870 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatgggctttaagcgacttctcggtaacttggcagttac

SEQ ID NO: 233871 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatgctttatccgcccctctgcatggtgggcctacatcg

SEQ ID NO: 233872 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatcttttatccgcccctctgcatggtgggcctacatcg

SEQ ID NO: 233873 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatctttatccgcccctctgcattggtgggcctacatcg

SEQ ID NO: 233874 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatctttatccgccccccttgcatggtgggcctacatcg

SEQ ID NO: 233875 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatcgtttatccgcccctctgcatggtgggcctacatcg

SEQ ID NO: 233876 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatcctttatccgcccctctgcatggtgggcctacatcg

SEQ ID NO: 233877 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatagcctgtccttttattacggccattagtcacatgag

SEQ ID NO: 233878 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaggtgcgtaccctctttagccgcctctggagattgaat

SEQ ID NO: 233879 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaggcttaagccttacttttctgggaccttgtcaactac

SEQ ID NO: 233880 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtagatattcacgttgaatcgccttgctcctcttagtctg

SEQ ID NO: 233881 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtagactcggatcatgtactgcgctcgctccccacgcctg

SEQ ID NO: 233882 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtacttccctgctcccgggacgacaagatcggtcgcattt

SEQ ID NO: 233883 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtactcggatcacagccaaccaagcccgcctcagtcatac

SEQ ID NO: 233884 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtactcgcctctgtcctcatggttcgaaccggtatgcatg

SEQ ID NO: 233885 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtacgtttcccgtctcggatctcccttattacccgctgtg

SEQ ID NO: 233886 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtacggtaacgcctcgatcctcgcatatatgatacgtctg

SEQ ID NO: 233887 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtacgacgtcgtgggcctcggtcctcatctcctgtgtaca

SEQ ID NO: 233888 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtacctccggtgttacacgccttatcctccattggtactg

SEQ ID NO: 233889 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaccggcactggagcgtccctggtggactaccaccttat

SEQ ID NO: 233890 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaccgcctcatcatcggacacgacgtgtatcagttgctg

SEQ ID NO: 233891 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaccgcctcagtccgcaggattacgtaatccgctgttaa

SEQ ID NO: 233892 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaatgggcttctaagcacttctcgtaacttggcagttac

SEQ ID NO: 233893 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaataaccttccgttactcgcctcgggtaagtgtgcgca

SEQ ID NO: 233894 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaataaccttccgttactcgcctcgggcaggtgtgcgca

SEQ ID NO: 233895 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaataacctcccgttactcgcctcgggcaagtgcgcgca

SEQ ID NO: 233896 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaagtattcacgttgaatcgccttgctcctctcagtctg

SEQ ID NO: 233897 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaacaaccttccgttactcgcctcgggcaagtgtgcgca

SEQ ID NO: 233898 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattctcgttgaatcgccttgctcctcttagtctg

SEQ ID NO: 233899 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattcatgttgaatcgccttgctcctcttagtctg

SEQ ID NO: 233900 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattcacgttgagtcgccttgctcctcctagtctg

SEQ ID NO: 233901 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattcacgttgactccccttgctcctcttagtctg

SEQ ID NO: 233902 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattcacgttgaatcgccttgctcctcttagtcta

SEQ ID NO: 233903 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattcacgttgaatcgccttgctcctcttagtccg

SEQ ID NO: 233904 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattcacgttgaatcgcctcgctcctcttagtctg

SEQ ID NO: 233905 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattcacgttgaatcgccctgctcctcctagtctg

SEQ ID NO: 233906 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattcacgttgaactcgccttctcctcttagtctg

SEQ ID NO: 233907 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattcacgttgaaccgcctcgctcctcctagtctg

SEQ ID NO: 233908 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattcacgtcgaatcgccttgctcctcttagtctg

SEQ ID NO: 233909 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattcacgctgaatcgccttgctcctcttagtctg

SEQ ID NO: 233910 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatatccacgttgaatcgccttgctcctcttagtctg

SEQ ID NO: 233911 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggttactggtacgcctcgatcttccacgtgcacgtaaatg

SEQ ID NO: 233912 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtgatcctcccccctgcctcgaagatttgtgcacatatc

SEQ ID NO: 233913 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtgatcctcccccccgcctcgaagatttgtgcacatgtc

SEQ ID NO: 233914 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtgatccctccccccgcctcgaagatttgtgcacatatc

SEQ ID NO: 233915 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtgactcatacgactagggactaccctagcacagcgtag

SEQ ID NO: 233916 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtgaacctcccccccgcctcgaagatttgtgcacatatc

SEQ ID NO: 233917 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtctgaccctgttatggactaccatatcagaaaggtact

SEQ ID NO: 233918 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtcgcgctgccctttgtttaaggcctttatacaaacgca

SEQ ID NO: 233919 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtcctgtgtacttgttgccacagacgttcagtgcccccg

SEQ ID NO: 233920 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtccgaacgcctcgatcctcgcataatatgatacgtctg

SEQ ID NO: 233921 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtccctgtgtcttgttgtcacagacgttcagtgcccccg

SEQ ID NO: 233922 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtccctgtgtcttgttgccacagacgttcagtgccctcg

SEQ ID NO: 233923 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtccctgtgtcttgctgccacagacgttcagtgcccccg

SEQ ID NO: 233924 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtccatggtacgcctcgattccgccatacatgcatgtaa

SEQ ID NO: 233925 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtcacgctgccctttgtttaaggcctttatacaaacgca

SEQ ID NO: 233926 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtatcatggtgactccgcctcgcaaccacgaccgttccg

SEQ ID NO: 233927 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtagatcgaactgtgccgcctcgcgcctctattcgtcgc

SEQ ID NO: 233928 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtaatcctcccccccgcctcgaagatttgtgcacatatc

SEQ ID NO: 233929 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gggttcgttctcctcgactacatgagattaataaacgcgc

SEQ ID NO: 233930 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gggtcatctgatatggctgtatattttggtaacctctctt

SEQ ID NO: 233931 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gggtatctgatatgctgtttatatttttggaacctctctt

SEQ ID NO: 233932 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gggtatctgatatgctgttatattttttggaacctctctt

SEQ ID NO: 233933 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gggtatctgatatgccgttgtatattttggaacctctctt

SEQ ID NO: 233934 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gggtatcctccccccccgctcgaagatttgtgcacatatc

SEQ ID NO: 233935 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggggtttcttctcctgactacatgagattaataaacgcgc

SEQ ID NO: 233936 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggggggctcggtgatgcgctatcatcaagaacgacgctac

SEQ ID NO: 233937 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gggccctgcctcagttctcgttatatcgtgtgttgtacaa

SEQ ID NO: 233938 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gggcactgaacgtctgtggcaacaagacacagggaccccg

SEQ ID NO: 233939 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gggatctcggatctggcgtactacttggacaggttccttc

SEQ ID NO: 233940 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggctacctgcatcgagcggacgaagacgagagatgctcgt

SEQ ID NO: 233941 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggctacccccattgagcgagattcgaaaaatttggcgcac

SEQ ID NO: 233942 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcgttcccttggtgccaccgcccgctatatctctgtctg

SEQ ID NO: 233943 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcggccgattcgcctcgatgctccacgtaacgttacgaa

SEQ ID NO: 233944 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcggccgactcgtctcgatgctccacgtaacgttacgaa

SEQ ID NO: 233945 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcggccgactcgcctcgatgctccacgtaacgttacaaa

SEQ ID NO: 233946 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcgccgactcgcctcgatgctccaccgtaacgttacgaa

SEQ ID NO: 233947 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcctcggcacggttcaatttcaaccgctatgttgataca

SEQ ID NO: 233948 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggccggagcgcctcgatcctcgcataatatggtacgtctg

SEQ ID NO: 233949 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggccggaacgcctcgatcctcgcataatatgatacgtctg

SEQ ID NO: 233950 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcccgtgtggttgagtttgctgcgtactagtgccatcga

SEQ ID NO: 233951 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcccctgtgtcttgttgccacagacgttcagtgcctccg

SEQ ID NO: 233952 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcccccgcctgagatccttgtctatgtgtacaccgtctg

SEQ ID NO: 233953 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggccaccccgtatcgagcggctcgtccttgatgtgtttaa

SEQ ID NO: 233954 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcacgcggaaagtcacacgagctatcgtgacgctggctc

SEQ ID NO: 233955 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggattctagattaaccgcctcggtcagcccagattgtgca

SEQ ID NO: 233956 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggagttgggtaagtccgcctctgttctccataccgcgcgg

SEQ ID NO: 233957 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggactggatcctcgcctccatactacgtggatttagattt

SEQ ID NO: 233958 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggactactccgatggacaatcgtaacttaggagtcgccta

SEQ ID NO: 233959 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggacatgtgttggtcatccaagattacttggttcacggcc

SEQ ID NO: 233960 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggacatgtgttggccatccaagactacttggttcacggcc

SEQ ID NO: 233961 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggaagaattccgtagctactactgattacatctttccaca

SEQ ID NO: 233962 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggaacccgtacagagtatggtgaactatcacctcgacact

SEQ ID NO: 233963 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggaaaagctgattcgttcgcctcgttcctccataggctcg

SEQ ID NO: 233964 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcttgcgtttcacgcacgcggattgtacccgaactgggtt

SEQ ID NO: 233965 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcttctacgccgaggacgtctttcgtgcactatcacgatt

SEQ ID NO: 233966 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctgtaggcacctgctctatatcgtggggagtaacaggtt

SEQ ID NO: 233967 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctgggctttcacgcacgcggattgtacccgaactgggtt

SEQ ID NO: 233968 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctgcgctttcacgcacgcggattgtacccgaactgggtt

SEQ ID NO: 233969 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctgacaggtcgtgttccgccttgttcctccgcgagacta

SEQ ID NO: 233970 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctcttggaacctcatcaattgcgtccggtttcgacccat

SEQ ID NO: 233971 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctcttatccggcggacgtctttcgtgcactatcacgatt

SEQ ID NO: 233972 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctcttatccggcaggacgtctttcgtgcactatcacgat

SEQ ID NO: 233973 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctcttatccggcaggacatctttcgtgcactatcacgat

SEQ ID NO: 233974 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggcttttacgcacgcggattgtacccggactgggtt

SEQ ID NO: 233975 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcactcggattgtacccgaactgggtt

SEQ ID NO: 233976 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgctgattgtacccgaactgggtt

SEQ ID NO: 233977 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcgggttgtacccgaactgggtt

SEQ ID NO: 233978 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtacctgaactgggtt

SEQ ID NO: 233979 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtacccgaattgggtt

SEQ ID NO: 233980 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtacccgaactgggtc

SEQ ID NO: 233981 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtacccgaactggggt

SEQ ID NO: 233982 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtacccgaactggatt

SEQ ID NO: 233983 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtacccgaaccgggtt

SEQ ID NO: 233984 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtacccgaaccgggtg

SEQ ID NO: 233985 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtacccgaacagggtt

SEQ ID NO: 233986 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattggacccgaactgggtt

SEQ ID NO: 233987 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgcacccgaactgggtt

SEQ ID NO: 233988 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggatggtacccgaactgggtt

SEQ ID NO: 233989 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggcttccacgcacgcggattgtgcccgaactgggtt

SEQ ID NO: 233990 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggcttcacgtccacgcggattgtaccgaactgggtt

SEQ ID NO: 233991 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggcttcacgtcacgcggattgtacccgaactgggtt

SEQ ID NO: 233992 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggcttcacgccacgcggattgtacccgaactgggtt

SEQ ID NO: 233993 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggcttcacgcacgcggattgtacccgaactgggttt

SEQ ID NO: 233994 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggcttcacgcacgcggattgtacccgaactagggtt

SEQ ID NO: 233995 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggcttcacgcacgcggattgtaccccgaactgggtt

SEQ ID NO: 233996 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggcttcacgcaccgcggattgtacccgaactgggtt

SEQ ID NO: 233997 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggcttacacgcacgcggattgtacccgaactgggtt

SEQ ID NO: 233998 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctctcacgcacgcggattgtacccgaactgggtt

SEQ ID NO: 233999 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctagctttcacgcacgcggattgtacccgaacgtgggtt

SEQ ID NO: 234000 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctagctttcacgcacgcggattgtaacccgaactgggtt

SEQ ID NO: 234001 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctacggcttcacgcactgcggattgtacccgaactggtt

SEQ ID NO: 234002 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccttcgtccagcggtgcgctggggactttatccctc

SEQ ID NO: 234003 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccattgtcgagcgaaaccgtgtggcgggtttagggc

SEQ ID NO: 234004 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccatctgtctagcgaggctggttaactactccaagc

SEQ ID NO: 234005 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccatcgtctagttgagtcacccttagttcatcaagc

SEQ ID NO: 234006 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccatcgtctagtgagtcatccttagttcatcaaggc

SEQ ID NO: 234007 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccatcgtctagtgagtcacccttagtttatcaaggc

SEQ ID NO: 234008 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccatcgtctagtgagtcacccttagttcatcaagga

SEQ ID NO: 234009 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccatcgtctagtgagtcacccttagttcaccaaggc

SEQ ID NO: 234010 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccatcgtctagtgacgtcaccttagttcatcaaggc

SEQ ID NO: 234011 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccatcgtctagctgagtcacccttagttcatcaagc

SEQ ID NO: 234012 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccatcgtcccagtgagtcacccttagttcatcaagc

SEQ ID NO: 234013 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccatcgtccagcgagtcacccttagttcatcaaggc

SEQ ID NO: 234014 - skipped

SEQ ID NO: 234015 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaagctttcacgcacgcggattgtacccgaactgggtt

SEQ ID NO: 234016 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttttctctcctgactacatgagattaataaacgcgtc

SEQ ID NO: 234017 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttgcttctcctgactacatgagattaatgaacgcgc

SEQ ID NO: 234018 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttcttctcctgactcacatgagattaataaacgcgc

SEQ ID NO: 234019 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttcttctccgtgactacatgagattactaaacgcgc

SEQ ID NO: 234020 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttctctcctgactacatgagattaataaaccgcatc

SEQ ID NO: 234021 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttgtggcactattcacagacttagcttaatctgcggt

SEQ ID NO: 234022 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttgtggcactattcacagacttagccttaatctgcgt

SEQ ID NO: 234023 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttgtggcactattcacagacttagcctaatctgcggt

SEQ ID NO: 234024 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttgtggcactatcacagacttagccttaatctgcggt

SEQ ID NO: 234025 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttcttctccctgactacatgagattaactaaacgcgc

SEQ ID NO: 234026 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtgttcttcggattctctgtgttctcctacgctcgcaa

SEQ ID NO: 234027 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtgttcttcggattctctgtgttcccctacgctcgcaa

SEQ ID NO: 234028 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtgtggcactattcacagacttagccttaatctgcggt

SEQ ID NO: 234029 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtgtggcactattcacagacttagccctaatctgcggt

SEQ ID NO: 234030 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtgtgctactatcacagacttagccttaatctgcggtc

SEQ ID NO: 234031 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttttcctgactacatgagattaataaacgcgc

SEQ ID NO: 234032 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttcttctgactacatgagattaataaacgcgc

SEQ ID NO: 234033 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcttgactacatgagattagtaaacgcgc

SEQ ID NO: 234034 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctggctacatgagattaatgaacgcgc

SEQ ID NO: 234035 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactgcatgagattaataaacgcgc

SEQ ID NO: 234036 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgaggttaataaacgcgc

SEQ ID NO: 234037 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattaatgaacgcgc

SEQ ID NO: 234038 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattaataaacgctc

SEQ ID NO: 234039 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattaataaacgcgt

SEQ ID NO: 234040 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattaataaacgagc

SEQ ID NO: 234041 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagataaataaacgcgc

SEQ ID NO: 234042 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgaatacatgagattaataaacgcgc

SEQ ID NO: 234043 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctaactacatgagattaataaacgcgc

SEQ ID NO: 234044 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttccctcgactacatgagattaataaacgcgc

SEQ ID NO: 234045 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttcccctgactacatgagattaataaacgcgc

SEQ ID NO: 234046 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttctcttcctgactacatgagattaataaacgcgc

SEQ ID NO: 234047 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcctctcctgactacatgagattaataaacgcgc

SEQ ID NO: 234048 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttcttctcctgactacatgagattaactaaacgcgc

SEQ ID NO: 234049 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgggtttcttctcctgactacatgagattaataacgcgc

SEQ ID NO: 234050 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggcttcttctcctgactacatgagattagtaaacgcgc

SEQ ID NO: 234051 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggattcttctctcgactagatgagattaataaacgcgc

SEQ ID NO: 234052 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggattcttcgctcgactacatgagattaataaacgcgc

SEQ ID NO: 234053 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgctctgtgtttccgttgactacaacggttaccacacag

SEQ ID NO: 234054 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgctattccggcactcatcgtctgtcgaccgtatttgtc

SEQ ID NO: 234055 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgctaggcctcatcgagcgtggtctgacgcacgactgtt

SEQ ID NO: 234056 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgccttcaggttccctaacgcgttagccttccgggaatg

SEQ ID NO: 234057 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgccatcttcgtactcctacaccatggtgcatataatta

SEQ ID NO: 234058 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgccatcctcgtactcctacaccatggtgcatataatta

SEQ ID NO: 234059 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgccacgtctctgtacctcttctcggattcgtcctccaa

SEQ ID NO: 234060 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgcaccccgatagtcatcttcgctggaccacccgcgtta

SEQ ID NO: 234061 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgatttcttctcctgactacatgagattaataaacgcgc

SEQ ID NO: 234062 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgagttcaggtccttcctcgcctgcctcagttctgatat

SEQ ID NO: 234063 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgaagtcgaaccgcctcgatcctcttcgtccacgtcctc

SEQ ID NO: 234064 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcctggtcagatccgtgtaagactggttccatgtccgcaa

SEQ ID NO: 234065 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcctgccgtgtgttcacctaagactacttagggtaggtaa

SEQ ID NO: 234066 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcctagtatgatgtcgactactacccccgcaccgcatctg

SEQ ID NO: 234067 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcctaggacatcacgtgggctaccacgacgctgatgctgt

SEQ ID NO: 234068 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgtttgacctcctatcctcccggtgtgcatgcattcac

SEQ ID NO: 234069 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgtgcattgggtcggtttggtggggactaccccttgta

SEQ ID NO: 234070 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgtgcatgggtcggtttggctggggactaccccttgta

SEQ ID NO: 234071 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgtcatagatctcctctcgagctatctcctatgcccgc

SEQ ID NO: 234072 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccggtttcttctcctgactacatgagattaataacgcgc

SEQ ID NO: 234073 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccggtacgccttacgattgcgcaatcggtaatcttggaa

SEQ ID NO: 234074 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccggccgactgcctcggttctcctaattatgccagtctg

SEQ ID NO: 234075 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcgtgggtcggttttggtgggggactacccccttgta

SEQ ID NO: 234076 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgccttgaatctccttctcggtcacgtgacatctgctg

SEQ ID NO: 234077 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcctctttgcgatcgtctgatcgttagcccgccccat

SEQ ID NO: 234078 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcctcaggtccccctaacgcgttagccttccggaatg

SEQ ID NO: 234079 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtgggttttggtgggggactacccccttgta

SEQ ID NO: 234080 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttggtggggggctacccccttgta

SEQ ID NO: 234081 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttggtgggggactgcccccttgta

SEQ ID NO: 234082 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttggtgggggactactcccttgta

SEQ ID NO: 234083 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttggtgggggactaccccctttta

SEQ ID NO: 234084 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttggtgggggactacccccttgtg

SEQ ID NO: 234085 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttggtgggggactacccccttgca

SEQ ID NO: 234086 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttggtgggggactacccacttgta

SEQ ID NO: 234087 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttggtgggggaccacccccttgta

SEQ ID NO: 234088 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttggtaggggactacccccttgta

SEQ ID NO: 234089 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttggtaagggactacccccttgta

SEQ ID NO: 234090 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggacggttttggtgggggactacccccttgta

SEQ ID NO: 234091 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgagtcggttttggtgggggactacccccttgta

SEQ ID NO: 234092 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcacgggtcggttttggtgggggactacccccttgta

SEQ ID NO: 234093 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcaccccgatagtcatcttcactggacacccgtgtta

SEQ ID NO: 234094 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccggaacgcctcgatcctcgcgtaatatgatacgtctg

SEQ ID NO: 234095 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgctgcctttattcgtctgatgatgtgcacctcgaga

SEQ ID NO: 234096 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgcctctgttctgcctgtgagtgacaccgtatgtctg

SEQ ID NO: 234097 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgcctctgttctgcctgcgagtgacaccgtatgtctg

SEQ ID NO: 234098 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgcctctgtcgtacactagtgtgcacgtaatgcgctt

SEQ ID NO: 234099 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgcctctgaagccctcctaagtgcactttaaaccgcg

SEQ ID NO: 234100 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgcctccgaagccctcctaggtgcactttaaaccgcg

SEQ ID NO: 234101 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgcctccgaagccctcctaagtgcactttaaaccgag

SEQ ID NO: 234102 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgcctccgaagccctcctaagtgcactgtaaaccgcg

SEQ ID NO: 234103 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgcctccgaagccctcctaagcgcactttaaaccgcg

SEQ ID NO: 234104 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgcctccgaagcccccctaagtgcactttaaaccgcg

SEQ ID NO: 234105 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgcctccgaagcccacctaagtgcactttaaaccgcg

SEQ ID NO: 234106 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgcctccaaagccctcctaagtgcactttaaaccgcg

SEQ ID NO: 234107 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgcctcagtccgtaccattcgtacgatggtaacacaa

SEQ ID NO: 234108 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgcctcagtcaccgttccgtgcgcacgaattctctaa

SEQ ID NO: 234109 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgcctcaaggcctctttacggatccggaaatacacaa

SEQ ID NO: 234110 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccatggtacgcctcgattccgcccatatatgcatgtaa

SEQ ID NO: 234111 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccatggtaagcctcgattccgcccatacatgcatgtaa

SEQ ID NO: 234112 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcatggcgttaatcttactctccgttaacttaggtcatgc

SEQ ID NO: 234113 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcatcgtacgctgttcccgcctctgttccttatcgctgcg

SEQ ID NO: 234114 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcatcctcgtgactgtctgttgatggctacatcattgttc

SEQ ID NO: 234115 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcatcctcgtgacggtctgttgatggctacatcattgttc

SEQ ID NO: 234116 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcagtgggttccatgctttaggcgcctcttatttcgggtc

SEQ ID NO: 234117 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcagcacttggactctcagcgcgcgacccatctctcggta

SEQ ID NO: 234118 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcactattccggtaagtcatcgtttaaccgtttgttgcaa

SEQ ID NO: 234119 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcactatccgttgtccgtcctcttgtggtattgcgcatgc

SEQ ID NO: 234120 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcacgggcactatctccgggctacctgagttggacgtggt

SEQ ID NO: 234121 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcacgggcactatctccgggctacctgagttgaacgtggt

SEQ ID NO: 234122 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcacactggactctcagcgcgcgaccccatctctgcagta

SEQ ID NO: 234123 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcaaggttcatctttgcttgactacacgcaattccgatga

SEQ ID NO: 234124 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatttgtttactaactcttgcccattgagcactgttcccg

SEQ ID NO: 234125 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gattcgccagccacatcaactatgatgacgcttgactgga

SEQ ID NO: 234126 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gattcacgctgccttgtttaaggcctttataccaaacgca

SEQ ID NO: 234127 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gattagtactgacggccgccttgatccttccgttagtctg

SEQ ID NO: 234128 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gattacgctgccctttgtttaaggcctttatacaaacgca

SEQ ID NO: 234129 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatgttccactgagctctggacactatccatgacgctcga

SEQ ID NO: 234130 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatgttaagcttacatacgcctgggtcactctttgttctg

SEQ ID NO: 234131 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatgtcctgacgctctggcactatccagattgaacgctca

SEQ ID NO: 234132 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatgtccatgagcttgctggcactatccagttgacgctca

SEQ ID NO: 234133 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatgtccatgagcttctggcactattccagttgacgctca

SEQ ID NO: 234134 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatgtccatgagccttctggcactatccagttgacgctca

SEQ ID NO: 234135 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatgggcttttaagcacttctcggtaacttgggcagttac

SEQ ID NO: 234136 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatggatccactgagccttcggcactatccattacgctca

SEQ ID NO: 234137 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatgaggccttaagcactttctcggataccttggcagtac

SEQ ID NO: 234138 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcttcgacacaacgtgatcacgtttggctcgctttcat

SEQ ID NO: 234139 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatctcgcctctgtcctcatggttcgaaccggtatgcatg

SEQ ID NO: 234140 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcgtcctcgagcttcggcatctatccagttacgctcta

SEQ ID NO: 234141 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcgtacttaccacctgacatcgcggggaactaatggtt

SEQ ID NO: 234142 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcggtccatgagccttcggcactatcagttgacgctca

SEQ ID NO: 234143 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcgggcccatgagccttcggcactatccattacgctca

SEQ ID NO: 234144 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcggatccgcctcgatctcgcatatatcgatacgtctg

SEQ ID NO: 234145 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcggagactactccgttggtctgcgggtgtcaccacga

SEQ ID NO: 234146 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcggagactactccgttggtctgcaggtgtcaacacga

SEQ ID NO: 234147 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcggacctgagtcttctggcactatcgattgacgctca

SEQ ID NO: 234148 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcggaccactgagccttcggcactatcattgacgctca

SEQ ID NO: 234149 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcggaccactgagccttcgcactatcagttgacgctca

SEQ ID NO: 234150 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcgacgctgccttgtttaaggcctttatacaaactgca

SEQ ID NO: 234151 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcgaccgctgccttgtttaaggcctttatacaaacgca

SEQ ID NO: 234152 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcgaccgctgcccttgttaaggcctttatacaaacgca

SEQ ID NO: 234153 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcgacactgcccttgtttaaggcctttatacaaacgca

SEQ ID NO: 234154 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatccttgctcgtataattcaggatggcttattatcagct

SEQ ID NO: 234155 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatccggggcccgcctcaagctagctacctccgttgtctg

SEQ ID NO: 234156 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatccggacgcctcgatcctcgccatatatgatacgtctg

SEQ ID NO: 234157 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcccgctgccctttgtttaaggcctttatacaaacgca

SEQ ID NO: 234158 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
gatccatggtacgcctcgattccgcccatacatgcatgta

SEQ ID NO: 234159 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatccatggtacacctcattccgcccatacatgcatgtaa

SEQ ID NO: 234160 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatccacgctgccctttgttaaggcctttatacaaacgca

SEQ ID NO: 234161 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcatgctgccctttgtttaaggcctttatacaaacgca

SEQ ID NO: 234162 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcatcgcttgcccttgtttaaggccttatacaaacgca

SEQ ID NO: 234163 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcatcgctgcctttgttaaggccttatacaaactgaca

SEQ ID NO: 234164 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcagcgcttgccttgtttaaggcctttatacaaacgca

SEQ ID NO: 234165 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgcttgcccttgtttaaggcctatatacagacgca

SEQ ID NO: 234166 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgcttgccctgtttaaggcctttatacaaactgca

SEQ ID NO: 234167 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctggcctttgtttaaggcctttatacaaacgca

SEQ ID NO: 234168 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccttttgtttaaggcctttatacaaacgca

SEQ ID NO: 234169 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgcctttgtttaaggcctttatacaaacgcat

SEQ ID NO: 234170 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggtctttatacaaacgca

SEQ ID NO: 234171 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggcttttatacaaacgca

SEQ ID NO: 234172 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggcctttatagaaacgca

SEQ ID NO: 234173 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggcctttatacaaacgta

SEQ ID NO: 234174 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggcctttatacaaacaca

SEQ ID NO: 234175 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggcctttacacaaacgca

SEQ ID NO: 234176 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggcctttaaacaaacgca

SEQ ID NO: 234177 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggccttcataacaacgca

SEQ ID NO: 234178 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggcctcgatacaaacgca

SEQ ID NO: 234179 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggcctatatacaaacgca

SEQ ID NO: 234180 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggccgttatacaaacgca

SEQ ID NO: 234181 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggccattatacaaacgca

SEQ ID NO: 234182 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggactttatacaaacgca

SEQ ID NO: 234183 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgttcagagcctttatacaaacgca

SEQ ID NO: 234184 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttatttaaggccttgatacaaacgca

SEQ ID NO: 234185 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgcccttgtttaaggtcctttatacaaacgca

SEQ ID NO: 234186 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgcccttgtttaaggcctttatagcaaacgca

SEQ ID NO: 234187 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgcccttgtttaaggcctttatacaaacgcat

SEQ ID NO: 234188 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgcccttggtttaaggcctttatacaaacgca

SEQ ID NO: 234189 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgcccgttgtttaaggcctttatacaaacgca

SEQ ID NO: 234190 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctagccttgtttagggaccttatacaaacgaca

SEQ ID NO: 234191 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgccgccctttgtttgaggcctttatacaaacgca

SEQ ID NO: 234192 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacatgccctttgtttaaggcctttatacaaactgca

SEQ ID NO: 234193 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacagtaattctgcccctctgatggaaccggttactt

SEQ ID NO: 234194 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacagtaattctgcccctctgatgaaaccggttactt

SEQ ID NO: 234195 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacactgccctttgtttaaggccttgatacaaacgca

SEQ ID NO: 234196 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacactgccctttgtttaaggccttaatacaaacgca

SEQ ID NO: 234197 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacactgccctttgtctaaggcctttatacaaacgca

SEQ ID NO: 234198 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacactgccctctgtttaaggcctttatacaaacgca

SEQ ID NO: 234199 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatattcaatccggcccctctgcgataaccggttatgatg

SEQ ID NO: 234200 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatatctttatccgcccctctgcatggtgggcctacatca

SEQ ID NO: 234201 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatagttccctgctctaaccgcctctttaacctcgcactt

SEQ ID NO: 234202 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatagcgtttcacgcacgcggattgtacccgaactgggtt

SEQ ID NO: 234203 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagttctcggatctggcgtactacttggacaggttccttc

SEQ ID NO: 234204 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagtctcgagacgcatcacgatccttaatcctccccactg

SEQ ID NO: 234205 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagtacatgactcgcgtttatagactactgataatttagc

SEQ ID NO: 234206 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaggtctcggatctggcgtactacttggacaggttccttc

SEQ ID NO: 234207 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaggtctcggatccggcgtactacttggacaggttccttc

SEQ ID NO: 234208 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaggtacgtgatcgcgtttatagactactgtaattttagc

SEQ ID NO: 234209 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaggaaccggttcgccgcctggatcttcccctgtagacta

SEQ ID NO: 234210 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagctttccgtctccttttagtacatcacagctccaggtg

SEQ ID NO: 234211 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagcctccagaacatgcatgtgacttagactaagacttat

SEQ ID NO: 234212 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagcagcgacgaaacccgactcggtcacgtcatccataag

SEQ ID NO: 234213 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatttcggatctggcgtactacttggacaggttccttc

SEQ ID NO: 234214 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctggtgtactacttggacaggttccttc

SEQ ID NO: 234215 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctggcgtcactacttggacagttccttc

SEQ ID NO: 234216 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctggcgtattacttggacaggttccttc

SEQ ID NO: 234217 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctggcgtactacttggacaggttccctc

SEQ ID NO: 234218 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctggcgtactacttggacaggtcccttc

SEQ ID NO: 234219 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctggcgtactacttggacagggtccttc

SEQ ID NO: 234220 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctggcgtactacttagacaggttccttc

SEQ ID NO: 234221 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctggcgtactactcggacaggttccttc

SEQ ID NO: 234222 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctggcgtactacctggacaggttcctcc

SEQ ID NO: 234223 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctggcgtaccacttggacaggttccttc

SEQ ID NO: 234224 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctgcgtatctacttggacaggttccttc

SEQ ID NO: 234225 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctgcggtactacttggacaggttccttc

SEQ ID NO: 234226 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatcaggcgtactacttggacaggttccttc

SEQ ID NO: 234227 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggacctggcgtactacttggacagggtccttc

SEQ ID NO: 234228 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggaactggcgtactacttggacaggttccttc

SEQ ID NO: 234229 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcgaatctggcgcactacttggacaggttccttc

SEQ ID NO: 234230 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatcctcggatctgcgtactacttggacaggttccttc

SEQ ID NO: 234231 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagacctcggatctggcgtactacttggacaggttccttc

SEQ ID NO: 234232 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactcggatctcatctaactcctgaaccgggccatctaag

SEQ ID NO: 234233 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactcgagactgcctctgttcttctgctacagactgtgca

SEQ ID NO: 234234 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactcgagactgcctctgtccttctgctacagactgtgca

SEQ ID NO: 234235 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactcgagaccgcctctgttcttctgctacagactgtgca

SEQ ID NO: 234236 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactatccgtttgtccgtcctcttgtggtattgcgcatgc

SEQ ID NO: 234237 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactaggcttcacgcacacggattgtacccgaactgggtt

SEQ ID NO: 234238 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactactcgcatcgagcgttgtcaagcggagtgcaagtta

SEQ ID NO: 234239 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactactcgcatcgagcgagtcttatgaggcctactactt

SEQ ID NO: 234240 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactactcgcatcgagcaagtcttatgaagcctactactt

SEQ ID NO: 234241 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactactcgcatcgaagcaagtcttatgagcctactactt

SEQ ID NO: 234242 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactacctgcatcgagcggacgaagatgagagatgctcgt

SEQ ID NO: 234243 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactacccgtatcgagacgagttcttcgttgggttcagcc

SEQ ID NO: 234244 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactaccccccatcgagcggtttaccggtggcgacaacgc

SEQ ID NO: 234245 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactacccccatcgagcggtttactggttggcgacaacgc

SEQ ID NO: 234246 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactacccccatcgagcggtttacaggttggcgacaacgc

SEQ ID NO: 234247 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gacgttgtggcactattcacagacttagccttaatctggt

SEQ ID NO: 234248 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gacgtacttaccaccctgacatcgcggggaactaatggtt

SEQ ID NO: 234249 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gacggtttctctcctgactacatgagattaataaacgcgc

SEQ ID NO: 234250 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gacggttcttctcctgactacatgagattaataaacgcgc

SEQ ID NO: 234251 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gacggtcacgccttgatacctctcaactcttttcgtactg

SEQ ID NO: 234252 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gacggccttccaatcctccttgtctgcagttcccgccctg

SEQ ID NO: 234253 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gacgatctcggatctgcgtatctacttggacagttccttc

SEQ ID NO: 234254 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gacgatctcggatctgcgtactacttggacaggttccttc

SEQ ID NO: 234255 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaccgcctcagtccgtaccattcgtacgatggtaacacaa

SEQ ID NO: 234256 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gacccggggcccgcctcaagctagctacctccattgtctg

SEQ ID NO: 234257 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaccacggtacgcctcgattccgcccatacatgcatgtaa

SEQ ID NO: 234258 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaccaatgccgaacttctgggactacccagatcaacgtcg

SEQ ID NO: 234259 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gacattccttggattctctgcccgcttcgcccatgtcccg

SEQ ID NO: 234260 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaatttgcccgctcttagccgcctctaacaggtcactgat

SEQ ID NO: 234261 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaattagtactgacggccgccttgatcctccgttagtccg

SEQ ID NO: 234262 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaattagtactgacggccgccttgatcctccgttagtcag

SEQ ID NO: 234263 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaattagtactgacggccgccttgatcctccgttagcctg

SEQ ID NO: 234264 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaatgagtactgacggccgccttgatcctccgttagtctg

SEQ ID NO: 234265 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaatctacaattgtccatatcctgcaacaaaacctccctg

SEQ ID NO: 234266 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaatcgacgctgccttgtttaaggcctttatacaaacgca

SEQ ID NO: 234267 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaatcgaccgctgccttgtttaaggcctttatacaacgca

SEQ ID NO: 234268 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaatcgaccgctgccttgtttaagcctttatacaaacgca

SEQ ID NO: 234269 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaatcgaccgcctgccttgtttaagcctttatacaacgca

SEQ ID NO: 234270 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaatcgaccgcctgaccttgttaagcctttatacaacgca

SEQ ID NO: 234271 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaatccgggaccgcctcaagctagctacctccattgtctg

SEQ ID NO: 234272 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaatcagtactgacggccgccttgatcctccgttagtctg

SEQ ID NO: 234273 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaatcacgctgccctttgtttaaggccttatacaaacgca

SEQ ID NO: 234274 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaataggacctacgcccgcctcagtctgactcatcgtctg

SEQ ID NO: 234275 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaatagatgacgaaatatgtcgctcccgtctcgttccaaa

SEQ ID NO: 234276 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggattctcgcctcccatactacgtggattagattt

SEQ ID NO: 234277 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggatcctcgcctccctactacgtggatttagattt

SEQ ID NO: 234278 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggatcctcgcctccatactacgtggatttagattc

SEQ ID NO: 234279 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggatcctcgcctccatactacctggatttagattt

SEQ ID NO: 234280 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggatcctcgccctacatactacgtggattagattt

SEQ ID NO: 234281 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggatcctcacctccatactacgtggatttagattt

SEQ ID NO: 234282 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactgatcctcgcctccatactacgtggatttagatttt

SEQ ID NO: 234283 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactgatcctcgcctccatactaccgtggatttagattt

SEQ ID NO: 234284 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccggggcccgcttcaagctagctacctccattgtctg

SEQ ID NO: 234285 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccggggcccgcctcaagctagctacctccattgtccg

SEQ ID NO: 234286 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
gaaccggggcccgcctcaagctagctacctccattgtcag

SEQ ID NO: 234287 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccggggcccgcctcaagctagctacatccattgtctg

SEQ ID NO: 234288 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccggggcccgccccaagctagctacctccattgtctg

SEQ ID NO: 234289 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccgggcccgcctcaagtctagctacctccattgtctg

SEQ ID NO: 234290 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccgggcccgcctcaagctagcttacctccattgtctg

SEQ ID NO: 234291 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccgggcccgcctcaagctagctgacctccattgtctg

SEQ ID NO: 234292 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccgggcccgcctcaagctagctaccttccattgtctg

SEQ ID NO: 234293 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccgggcccgcctcaagctagctaacctccattgtctg

SEQ ID NO: 234294 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccgggcccgcctcaagctagcctacctccattgtctg

SEQ ID NO: 234295 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccgggcccgcctcaagcctagctaccttccattgctg

SEQ ID NO: 234296 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccgggaccgcctcaagctagctacctacattagtctg

SEQ ID NO: 234297 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccgggacccgcctcgagctagctacctccattgtctg

SEQ ID NO: 234298 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccatggtcggcctcgtaacccttaagatgcatcttaa

SEQ ID NO: 234299 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaacacgctgccctttgtttaaggcctttatacaaacgca

SEQ ID NO: 234300 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaatcagtgtaattgtctactgggcgctatcccaggcaa

SEQ ID NO: 234301 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaaccggggcccgcctcaagctagctacctccatgtctg

SEQ ID NO: 234302 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttttatccggcaggacgtctttcgtgcactatcacgatt

SEQ ID NO: 234303 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctttaattccgtgactacactgattacttattgcgggcat

SEQ ID NO: 234304 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttgtccaggactacctggtcagttcaagctagatttgtg

SEQ ID NO: 234305 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttggacgtccaactgttgcctcggctcctccatcggata

SEQ ID NO: 234306 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttgagctgaatcactccgcctcgctcctccagggctacg

SEQ ID NO: 234307 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttgagcacagttcgtcggtccgcgccgctatgcccgtta

SEQ ID NO: 234308 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttccttcggatctcaacatattgccgcctcacatccgac

SEQ ID NO: 234309 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttcctcggatcttcagcatattgccgcctcgcatccgac

SEQ ID NO: 234310 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttcctcggatcttcaacatattgccgcctcgcttccgac

SEQ ID NO: 234311 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttcctcggatcttcaacatattgccgcctcgcatccaac

SEQ ID NO: 234312 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttccccctgagtgttgagtcggtcaagcactatcttgaa

SEQ ID NO: 234313 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttattcctctggcaaaaatcgatatagcccatttgcgcg

SEQ ID NO: 234314 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttagtgggcccctagctgcctcgattctaagtgcacaga

SEQ ID NO: 234315 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttagtgatttcgcggcccctctgtttagtggccattgga

SEQ ID NO: 234316 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttagtgatttcgccgcccctctgtttggtggccattgga

SEQ ID NO: 234317 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttagtgatttcgccgcccctctgtttagtggccattggg

SEQ ID NO: 234318 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttagtgatttcgccgcccctctgtttagtggccattgaa

SEQ ID NO: 234319 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttagtgatttcgccgcccctctgtttactggccattgga

SEQ ID NO: 234320 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttagtgatttcgccgcccctctgcttagtggccattgga

SEQ ID NO: 234321 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttagtgatttcgccgcccctccgtttagtggccattgga

SEQ ID NO: 234322 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttagtgatttcgccgcccccctgtttagtggccattgga

SEQ ID NO: 234323 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttagtgatttcgccgaccctctgtttagtggccattgga

SEQ ID NO: 234324 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttagtgatttagccgcccctctgtttagtggccattgga

SEQ ID NO: 234325 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttagtgacttcgccgcccctctgtttagtggccattgga

SEQ ID NO: 234326 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttacgtgatttgccgcccctctgtttagtggccattgga

SEQ ID NO: 234327 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttacgtgatttccgccgccctctgttaatggccattgga

SEQ ID NO: 234328 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgttatccggcaggacgtctttcgtgcactatcacgatt

SEQ ID NO: 234329 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgtactaccgcctgtactcctagcgcatcgcttccccgg

SEQ ID NO: 234330 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctggccgacatgcatgattgcctgggagtccccacaatag

SEQ ID NO: 234331 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctggccgacatgcatgattgcctgggagtccccaacatgt

SEQ ID NO: 234332 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcttatccggcagacgtctttcgtgcactatcacgatt

SEQ ID NO: 234333 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcgctccctgtcattcgggcactatcccgataatacga

SEQ ID NO: 234334 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcctctgctctccctcttggatcgcgtacgtggatatg

SEQ ID NO: 234335 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcctctgctctccctctcggatcgcgtacgtgtatatg

SEQ ID NO: 234336 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcctcggtctgcccctaatgttgcaacataatggtaaa

SEQ ID NO: 234337 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcctcggtctacccctaatgttgcaacataatggtata

SEQ ID NO: 234338 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcctcagtctacccctaatgttgcaacataatggtaaa

SEQ ID NO: 234339 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcctaatactacccaatgtcgtgcttcgaagttctgta

SEQ ID NO: 234340 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgccacgccgacgcctatcgttacgcctatatcggtaat

SEQ ID NO: 234341 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcagcaacacaaacgagaccaccccgtatatagaaacg

SEQ ID NO: 234342 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcacccgatagtcatctttcactggaccacccgtgtta

SEQ ID NO: 234343 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgaagatattgtgcaggccgcctcgcaattcctcctatt

SEQ ID NO: 234344 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctttatcggcaagacgtctttcgtgcactatcacgatt

SEQ ID NO: 234345 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctttatccggcaagactctttcgtgcactatcacgatt

SEQ ID NO: 234346 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctttatccgcagacgtctttcgttgcactatcacgatt

SEQ ID NO: 234347 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttgttcggcaggacgcctttcgtgcactatcacgatt

SEQ ID NO: 234348 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttgtccggcgggacgtctttcgtgcactatcacgatt

SEQ ID NO: 234349 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttgtccggcaggacgtctttcgtgcactatcacgatc

SEQ ID NO: 234350 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttccccggcaggacgtctttcgtgcactatcacgatt

SEQ ID NO: 234351 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatttggcaggacgtctttcgtgcactatcacgatt

SEQ ID NO: 234352 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatgcggcaggacgtctttcgtgcactatcacgatt

SEQ ID NO: 234353 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatctggcgggacgtctttcgtgcactatcacgatt

SEQ ID NO: 234354 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatctggcaggactctttcgtagcactatcacgatt

SEQ ID NO: 234355 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatctagcaggacgtctttcgtgcactatcacgatt

SEQ ID NO: 234356 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccgtcaggacgtctttcgtgcactatcacgatt

SEQ ID NO: 234357 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccgtcaggacgtctttcgtgcactatcacgatg

SEQ ID NO: 234358 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcaggacgtctttctgcactatcacgatc

SEQ ID NO: 234359 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcaggacgtctttcgtgcactatcacgat

SEQ ID NO: 234360 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcagacgtcttcttgcgactatcacgatt

SEQ ID NO: 234361 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggctggacgtctttcgtgcactatcacgatt

SEQ ID NO: 234362 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggctaggacggtctttctgccatatcacgat

SEQ ID NO: 234363 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcgggacgtctttcgtgcgctatcacgatt

SEQ ID NO: 234364 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcgggacgtctttcgtgcactatcacgatc

SEQ ID NO: 234365 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcgggacgtctctcgtgcactatcacgatt

SEQ ID NO: 234366 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcggagcgtctttcgtgcactatcacgatt

SEQ ID NO: 234367 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggccggacgtctttcgtgcactatcacgatt

SEQ ID NO: 234368 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggccaggacgtctttctgcactatcacgatt

SEQ ID NO: 234369 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggccagacgtctttcgtgcactatcacgatt

SEQ ID NO: 234370 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcagggcgtctctcgtgcactatcacgatt

SEQ ID NO: 234371 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcagggactctttcgtgcactatcacgatt

SEQ ID NO: 234372 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggaggtctttcgtgcactatcacgatt

SEQ ID NO: 234373 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggactctttcgtgcacctatcacgatt

SEQ ID NO: 234374 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggactctttcgtgcaactatcacgatt

SEQ ID NO: 234375 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggactcgttcttgcgactatcacgatt

SEQ ID NO: 234376 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgttcttcgtgcactatcacgatt

SEQ ID NO: 234377 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtgtttcgtgcactatcacgatt

SEQ ID NO: 234378 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgctctatcacgatt

SEQ ID NO: 234379 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcgctatcgcgatt

SEQ ID NO: 234380 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcgctatcacgatc

SEQ ID NO: 234381 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcgctaccacgatt

SEQ ID NO: 234382 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcagtatcacgatt

SEQ ID NO: 234383 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcacttatcacgat

SEQ ID NO: 234384 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactatcaggatt

SEQ ID NO: 234385 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactatcactatt

SEQ ID NO: 234386 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactatcacgtct

SEQ ID NO: 234387 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactatcacgtat

SEQ ID NO: 234388 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactatcacgaaa

SEQ ID NO: 234389 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtacactatcacgatt

SEQ ID NO: 234390 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgagcactatcacgatt

SEQ ID NO: 234391 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttagtgcactatcacgatt

SEQ ID NO: 234392 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtcttcgttgcactatcacgatt

SEQ ID NO: 234393 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtcttcgtgccactatcacgatt

SEQ ID NO: 234394 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtcttcgtgcactatcatcgatt

SEQ ID NO: 234395 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtcttcgtagcactatcacgatt

SEQ ID NO: 234396 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctcttgtgcactatcacgatt

SEQ ID NO: 234397 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtcgttcgtgcactatcacgatt

SEQ ID NO: 234398 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtccttcgtgcaccatcacgatt

SEQ ID NO: 234399 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtccctcgtgcactatcacgatt

SEQ ID NO: 234400 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtcattcgcgcactatcacgatt

SEQ ID NO: 234401 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgcctttcgtgcgctatcacgatt

SEQ ID NO: 234402 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgcctttcgtgcactatcacgatc

SEQ ID NO: 234403 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgcctttcgtgcactaccacgatt

SEQ ID NO: 234404 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcagacgtctttccgtgcactatcacgatt

SEQ ID NO: 234405 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcagacgtcttcggtgcactatcacagatt

SEQ ID NO: 234406 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcagaacgtctttcgtgcgctatcacgatt

SEQ ID NO: 234407 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggaggacgatctttcgtgcactatcacgatt

SEQ ID NO: 234408 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggaaggacgtctttcgtgcactatcacgatt

SEQ ID NO: 234409 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccgccaggacgtctttcgtgcactatcacgatt

SEQ ID NO: 234410 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccgacagggcgtctttcgtgcactatcacgatt

SEQ ID NO: 234411 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccgacaggacgttcttcgtgcactatcacgatt

SEQ ID NO: 234412 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatcccggcaggacgtctttcgtgcactatcacgat

SEQ ID NO: 234413 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatcccggcaagacgtcttcgtgcactatcacgatt

SEQ ID NO: 234414 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
ctcttatcccggaggacgtctttcgtgcactatcacgatt

SEQ ID NO: 234415 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccagcaggacgtctttcgtgcaccatcacgatt

SEQ ID NO: 234416 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttactcggcaggacgtctttcgtgcactatcacgatt

SEQ ID NO: 234417 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttaacgccgaggacgtctttcgtgcactatcacgatt

SEQ ID NO: 234418 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttaaccggcaggacgtctttcgtgcactatcacgatt

SEQ ID NO: 234419 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctcggataacgttaatcgatccttctgtacgtacacga

SEQ ID NO: 234420 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctcattcggcaggacgtctttcgtgcactatcacgatt

SEQ ID NO: 234421 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctcatccggcagggcgtctttcgtgcactatcacgact

SEQ ID NO: 234422 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctcatccggcaggacgtcttcgtgcgctatcagcgtat

SEQ ID NO: 234423 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctatccgtttgtccgtcctcttgtggtattgcgcatgc

SEQ ID NO: 234424 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctatccggcaggatcgtctttcgtgcactatcacgatt

SEQ ID NO: 234425 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctatccggcaggacgtctttcgtgcactatcatcgatt

SEQ ID NO: 234426 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctatccgcaggacgatctttcgtgacactatcacgatt

SEQ ID NO: 234427 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctacactcccgattgctgcctcgatggtgcatgcagca

SEQ ID NO: 234428 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctaatccggcaggacgtctttcgtgcactatcacgatt

SEQ ID NO: 234429 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcgggatcgtctgttgcacctcctacagccgcctctata

SEQ ID NO: 234430 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcgggacgcctctggtcctaccggcactatgatacgtat

SEQ ID NO: 234431 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcggatcgcctcggtcctgccatgtatcgatactagcta

SEQ ID NO: 234432 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcgagacgcctcgtatcatgtacaaatgtacctttgtaa

SEQ ID NO: 234433 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccttatccggcaggacgtcttcgtgcactatcacgatt

SEQ ID NO: 234434 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcctattgtgagcctctccagccgcctcaactcttgtcc

SEQ ID NO: 234435 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcctatccggcaggacgtctttcgtgcactatcacaatt

SEQ ID NO: 234436 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccgtagatgcgcgcttatgtgggctgcctgtgtcacac

SEQ ID NO: 234437 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccctcggatcttcaacatattgccgcctcgcatccgac

SEQ ID NO: 234438 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccatggtacgcctcgattccgcccatacacgcatgtaa

SEQ ID NO: 234439 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccaccgcgcaagtcgtttacgcagactactgcgacgct

SEQ ID NO: 234440 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccaaggcgattgtcgttattgccggactacctgcattt

SEQ ID NO: 234441 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctattatccggcaggacatctttcgtgcactatcacgatt

SEQ ID NO: 234442 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctatcctaggacgaacctaggcaacagaccagcctcctca

SEQ ID NO: 234443 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctagcttcctcgaggtcttcctctgctgtatccggattgg

SEQ ID NO: 234444 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctagcctcctcgaagtcttcctctgctgtatccggattgg

SEQ ID NO: 234445 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctactggtcatgaacggtgactacaccggttgtagtgact

SEQ ID NO: 234446 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctactccggatgagtcacctcgcattcctccgttcgtctg

SEQ ID NO: 234447 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctactccggatgagctgcctcgcattcctccgttcgtctg

SEQ ID NO: 234448 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctactccggatgagccacctcgcattcctcctttcgtctg

SEQ ID NO: 234449 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctactccggatgagccacctcgcattcctccgctcgtctg

SEQ ID NO: 234450 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctactccggatgagccacctcgcattcctccattcgtctg

SEQ ID NO: 234451 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctactccccggtcttgaatcagccgcacaagcccgattga

SEQ ID NO: 234452 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctaccccggatgagccacctcgcattcctccgttcgtctg

SEQ ID NO: 234453 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctaagcccggtttgcccgcctcagttcccctacggttatt

SEQ ID NO: 234454 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctaaatcttcctgaggccgccccatgggcacattctcgta

SEQ ID NO: 234455 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctaaaatcttcccgagccgcctcgaaaactttgaaatgcg

SEQ ID NO: 234456 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgttttctcggatccaaacgcatatcctcctccgcctcgt

SEQ ID NO: 234457 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgtttctcggattactctattataccgcctcactccactg

SEQ ID NO: 234458 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgtttctcggattactctactataccgcctcactccactg

SEQ ID NO: 234459 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgttgttcttctcctgactacatgagattaataaacgcgc

SEQ ID NO: 234460 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgttgtggcactattcacagacttagccttaatctgcggt

SEQ ID NO: 234461 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgttggacctccgatacgctgcctcgagtctggaagctca

SEQ ID NO: 234462 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgttggaagactactttcattttagctgccagctgttctc

SEQ ID NO: 234463 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgtgttgcagtcactgtccgcctcggtcttaccgtctggc

SEQ ID NO: 234464 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgtgcagcctcggtcctacacagcatggccatgccgttat

SEQ ID NO: 234465 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgtcgtcttcccgcattgccgcaattgccatacattaata

SEQ ID NO: 234466 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgtagtgatttcgccgcccctctgtttagtggccattgga

SEQ ID NO: 234467 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgtaggtcgcctggtccgcctcgatcctctataccgtctg

SEQ ID NO: 234468 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggtgttctcggatcggtcagtttcttccgttcctcaccg

SEQ ID NO: 234469 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggtgtcttcgttcgctcaggccgccttgattttcccaaa

SEQ ID NO: 234470 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggctaacgttcgtcgagggagcaaaaggtctatagacta

SEQ ID NO: 234471 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggctaacgttcatcgagggagcaaagggtctatagactt

SEQ ID NO: 234472 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggctaacgttcatcgagggagcaaagagtctatagacta

SEQ ID NO: 234473 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggctaacgttcatcgagggagcaaaaggtctgtagacta

SEQ ID NO: 234474 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggctaacgttcatcgagggagcaaaaggtctatagacaa

SEQ ID NO: 234475 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggctaacgttcatcgagggagcaaaaggtctataaacta

SEQ ID NO: 234476 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggctaacgttcatcgagggagcaaaaggtctacagacta

SEQ ID NO: 234477 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggctaacgtccatcgagggagcaaaaggtctatagacta

SEQ ID NO: 234478 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggccgcctcgaaactcacccttctcgatcgacacctgta

SEQ ID NO: 234479 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggccgcctcgaaactacccttctcggatcaacacctgta

SEQ ID NO: 234480 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggccgcctcgaaactacccttctcgatcaacacctgtaa

SEQ ID NO: 234481 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggccgcctcgaaaactacccttctcgatcaacacctgta

SEQ ID NO: 234482 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggccaacgttcatcgagggagcaaaaggtctatagacta

SEQ ID NO: 234483 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggatcccactgttagcagttcctccctcaggtgtgtcaa

SEQ ID NO: 234484 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggatcccactgttaacagttcctccctcaggcgtgtcaa

SEQ ID NO: 234485 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggaacgtcgccttggtcttcccacattaccgtcctccta

SEQ ID NO: 234486 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctgtccgcatcgagcgggttcttcgataatatgcaaca

SEQ ID NO: 234487 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctgcctcgatgactagtcagaacacgcgacacgttatc

SEQ ID NO: 234488 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctcttcgctcccacggatctgtattttggctgtctaga

SEQ ID NO: 234489 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctattcgtagatccgtctctcactacgcgtatggaatc

SEQ ID NO: 234490 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgggcgagcactttgtgcgatcacaca

SEQ ID NO: 234491 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgatcgagcactttgtgcgatcacaca

SEQ ID NO: 234492 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgagcgagcattttgtgcgatcacaca

SEQ ID NO: 234493 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgagcgagcactttgtgggatcacaca

SEQ ID NO: 234494 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgagcgagcactttgtgcggtcacaca

SEQ ID NO: 234495 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgagcgagcactttgtgcgatcactca

SEQ ID NO: 234496 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgagcgagcactttgtgcgatcacata

SEQ ID NO: 234497 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgagcgagcactttgtgcgatcacacg

SEQ ID NO: 234498 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgagcgagcactttgtgagatcacacg

SEQ ID NO: 234499 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgagcgagcacgttgtgcgatcacaca

SEQ ID NO: 234500 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatcgcctatcgagcgaacacgtgttgccgtttcgtg

SEQ ID NO: 234501 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatcgccatcgagcgaacagtgtgccgttttcggttg

SEQ ID NO: 234502 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatcctcatcgagcgggttcttcgataatatgcaaca

SEQ ID NO: 234503 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctcttgtggtattgcgcgtgc

SEQ ID NO: 234504 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctcttgtggtatcgcgcatgc

SEQ ID NO: 234505 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctctcgtggtatcgcgcatgc

SEQ ID NO: 234506 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgttgtccgtcctcttgtcggtattgcgcatgc

SEQ ID NO: 234507 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtcatcgagcgcatgatatgcgtctgcttgtt

SEQ ID NO: 234508 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtcatcgagcgcatgatatgcgtctgcttatt

SEQ ID NO: 234509 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtatcgagcgggttcttcgataatatgcaaca

SEQ ID NO: 234510 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtagatccgtctctcactacgcgtatggaatc

SEQ ID NO: 234511 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtagatccgtcgctcactacgcgtatggaatc

SEQ ID NO: 234512 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtagatccgtcactcactacgcgtatggaacc

SEQ ID NO: 234513 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtagataacgtcctctcctgggctcaatgttt

SEQ ID NO: 234514 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtagataacgtcctctcctgggcccaatgttt

SEQ ID NO: 234515 - skipped

SEQ ID NO: 234516 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccggaagtcgagtcttgagtgtctgtaacacgta

SEQ ID NO: 234517 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcttgtccgtcctcttgtggtattgcgcatgc

SEQ ID NO: 234518 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcttggggcgttcttctctacatttcgttacg

SEQ ID NO: 234519 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcttggggcgttcttctcaacatttcggtacg

SEQ ID NO: 234520 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcttgagcgtttctcctgctcggttaacctga

SEQ ID NO: 234521 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgtaacagtgtgccgtttcggtg

SEQ ID NO: 234522 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcggacagtgtgccgttttcggtg

SEQ ID NO: 234523 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgaagagtgtgccgttttcggtg

SEQ ID NO: 234524 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgaacggtgtgccgttttcggtg

SEQ ID NO: 234525 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgaacagtgtgccgtttttggtg

SEQ ID NO: 234526 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgaacagtgtgccgttttcggtt

SEQ ID NO: 234527 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgaacagtgtgccgttttcggta

SEQ ID NO: 234528 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgaacagtgtgccgttttcggcg

SEQ ID NO: 234529 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgaacagtgtgccgttttcgctg

SEQ ID NO: 234530 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgaacagtgtgccgtcttcggtg

SEQ ID NO: 234531 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgaacagtgtgcccgtttcggtg

SEQ ID NO: 234532 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgaacagtgtgcagttttcggtg

SEQ ID NO: 234533 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgaacagtgcgccgttttcggtg

SEQ ID NO: 234534 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccaccgagcgaacagtgtgccgttctcggtg

SEQ ID NO: 234535 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccaacgagcgaacagtgtgccgttttcggtg

SEQ ID NO: 234536 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcattgagcgggttcttcgataatatgcaaca

SEQ ID NO: 234537 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggtttttcgataatatgcaaca

SEQ ID NO: 234538 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggttcttcggtaatatgcaaca

SEQ ID NO: 234539 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggttcttcgatgatatgcaaca

SEQ ID NO: 234540 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggttcttcgataatatgcaacg

SEQ ID NO: 234541 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggttcgtcgataatatgcaaca

SEQ ID NO: 234542 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
cgctatccgcatcgagcgggtccttcgataatatgcaaca

SEQ ID NO: 234543 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcggctcttctcataatatgcaaca

SEQ ID NO: 234544 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgatcgtcgtaatactgcttccaa

SEQ ID NO: 234545 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcaggttcttcgataatatgcaaca

SEQ ID NO: 234546 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcaagcgggttcttcgataatatgcaaca

SEQ ID NO: 234547 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcaccgagtgaggtaacacccgtattcgggta

SEQ ID NO: 234548 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcaccgagcgggttcttcgataatatgcaaca

SEQ ID NO: 234549 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgacatcgagagagctacgtcatcaagcgctaa

SEQ ID NO: 234550 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgggtgtctggttaaacaacga

SEQ ID NO: 234551 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtgtctggttgaacgacga

SEQ ID NO: 234552 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtgtctggttaatcaacga

SEQ ID NO: 234553 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtgtctggttaaactacga

SEQ ID NO: 234554 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtgtctggttaaacaacta

SEQ ID NO: 234555 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtgtctggttaaacaacgt

SEQ ID NO: 234556 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtgtctggttaaacaacaa

SEQ ID NO: 234557 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtgtctggttaaaaacaga

SEQ ID NO: 234558 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtgtccggttaaacaacga

SEQ ID NO: 234559 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtgcctggttaaacaacga

SEQ ID NO: 234560 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtgactggttaaacaacga

SEQ ID NO: 234561 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagctcgagtgtctggttaaacaacga

SEQ ID NO: 234562 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcatgagtgtctggttaaacaacga

SEQ ID NO: 234563 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaaccgagcttgagtgtctggttaaacaacga

SEQ ID NO: 234564 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaaatcgagcgagaactctggtgttggcgcag

SEQ ID NO: 234565 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccccatcgagcgatcgtcgtaatactgcttccaa

SEQ ID NO: 234566 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccaaatcgagcttgagtgtctggttaaacaacga

SEQ ID NO: 234567 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctacccgcaccgagcgggttcttcgataatatgcaaca

SEQ ID NO: 234568 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctaatctgcattcgagcgagcacttgtgcgatcacaca

SEQ ID NO: 234569 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgtttgtaaacgtcaccgccttgttcctacctgcgctg

SEQ ID NO: 234570 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgtcttcccgcattgccgtcaattgccatacattaata

SEQ ID NO: 234571 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgtcttcccgcacttgccgcaattgccatacattaata

SEQ ID NO: 234572 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgtcttccccgcattgccgcaattgccatacgttaata

SEQ ID NO: 234573 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgtcttccccgcattgccgcaattgccatacattagta

SEQ ID NO: 234574 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgtcttccccgcattgccgcaattgccatacattaatg

SEQ ID NO: 234575 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgtcttccccgattgccgcaattgccaatacattaata

SEQ ID NO: 234576 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgtcttccccccattgccgcaattgccatacattaata

SEQ ID NO: 234577 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgtctcccctgcattgccgcaattgccatacattaata

SEQ ID NO: 234578 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgcttgcctcggatcgcgcgaacttctcccgtattgcg

SEQ ID NO: 234579 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgccacctcttgtcctcgtcaacaaaacgatgcgtacg

SEQ ID NO: 234580 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgccacctcgatctggaccgcaatatcatgatatgtca

SEQ ID NO: 234581 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgcagcctcggtcctactcagcatggccatgccattat

SEQ ID NO: 234582 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgcagcctcggtcctacacagcatggccatgcggttat

SEQ ID NO: 234583 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgcagcctcggtcctacacagcatggccacgccgttat

SEQ ID NO: 234584 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccttggccctcgctttcggtgcactgactcgctttctg

SEQ ID NO: 234585 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccttgctcctcacaccggtggtactctcgccatgttaa

SEQ ID NO: 234586 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccttgatcctcgctttcggtgcactgactcgctgtctg

SEQ ID NO: 234587 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccttgatccgcctccgtgcacggatagcacttgtgata

SEQ ID NO: 234588 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccttgaaattccctatatatgcatatatcagtctaggc

SEQ ID NO: 234589 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccttcgaacactgacgtcgcggaaccttcgattgctag

SEQ ID NO: 234590 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccttcgaaattcctatatatgcatatatcagtctaggc

SEQ ID NO: 234591 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcctgtagtcgtcccgtgcgtatgggtcgaaatgccgct

SEQ ID NO: 234592 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcctgcctcgatcctccacctatagttcctccctgtgca

SEQ ID NO: 234593 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcctctgtccaccggaaacacacatatgtgcagcgtctg

SEQ ID NO: 234594 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcctcgtttccttactgcagtaagtgttacatgttatgt

SEQ ID NO: 234595 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcctcggttctctaacgtgtccggccgtaaaacaatctg

SEQ ID NO: 234596 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcctcgatcacatactagtaacaatgatcatcgtaacta

SEQ ID NO: 234597 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcctcgatatgcagtcatgttctagaacgcttcccactg

SEQ ID NO: 234598 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcctcgaaattcctatatatgcatatatctagtctaggc

SEQ ID NO: 234599 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcctcgaaattccctatatatgcatatatcagtccaggc

SEQ ID NO: 234600 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcctcgaaattccctatatatgcatataccagtctaggc

SEQ ID NO: 234601 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcctcgaaattccccatatatgcatatatcagtctaggc

SEQ ID NO: 234602 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcctcgaaactccctatatatgcatatatcagtctaggc

SEQ ID NO: 234603 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcctatccgcatcgagcgggtctcgataatatgtcaaca

SEQ ID NO: 234604 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcctacctctcgcatccatacctcctgtgatcacgaaaa

SEQ ID NO: 234605 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccggcctcggtcctgttgaaacgtttcaaggaggcgtg

SEQ ID NO: 234606 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccgccttgctcttctctcgacgtatacgtatacggtga

SEQ ID NO: 234607 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccgccttgctcatcctatcgcaccggtgaatgttataa

SEQ ID NO: 234608 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccgcctcgaatctttcctaatacatatgtacacgcacg

SEQ ID NO: 234609 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccgcctccgatcctccattgggtggccataccattgta

SEQ ID NO: 234610 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccgcctcagtcctgcagtttaattaaacatgatgcatc

SEQ ID NO: 234611 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccccatcgttgcctattgatctcggaatgctagcacca

SEQ ID NO: 234612 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccatccgcttcgagcgactcgtcacttgctttcaaagc

SEQ ID NO: 234613 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccatccgccatcgagcgaacagtgtgccgttttcggtg

SEQ ID NO: 234614 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccatccgcatcgagcgggttcttcgataatatgcaaca

SEQ ID NO: 234615 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccatccgcatcgagcgggttcttcgataacatgcaaca

SEQ ID NO: 234616 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccacctctgtcttccgagcatcccggggtttgctcgtg

SEQ ID NO: 234617 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccacctcagtccttaggttaaccaattacttcgtcgta

SEQ ID NO: 234618 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccacatcggatcgatcctagctacatgtacctacgatt

SEQ ID NO: 234619 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcattctcatccccctttcgatcctcctttctttctggc

SEQ ID NO: 234620 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcacgactaatgcattggttttgtccacctttctctgta

SEQ ID NO: 234621 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcaatatattgtgattgcctctctccccaaatgcgtttg

SEQ ID NO: 234622 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgattcggtccggatcacgcctcggtcctgtaatacgccg

SEQ ID NO: 234623 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgatgggctttagctcactctcggtaacttgggcagttac

SEQ ID NO: 234624 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgatgcttgatctcctgtcgactctgcggctgagactact

SEQ ID NO: 234625 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgagtgtatgtccaccgtacgccccagtttgatccatgga

SEQ ID NO: 234626 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgagtgcttgatgtatagccgcctcgcgcctctaaggaca

SEQ ID NO: 234627 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgagtgcttctcgggtccagtttacgccctttggcctcca

SEQ ID NO: 234628 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgagtcggcagaatcgcatcctccttcatcgttctactcc

SEQ ID NO: 234629 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgagtcctcgtcttcctaattaccatggtacgctcgcctg

SEQ ID NO: 234630 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgagtatggcctgtaaacaatgtttacaccaccgctaccg

SEQ ID NO: 234631 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgacttctcggatctactcaggccgcacgccctgagtctg

SEQ ID NO: 234632 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgactatcgctgatcgagtgagcgtcacgaaaacaggctt

SEQ ID NO: 234633 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgaatttgcgatgattttctgacgctattcagtttccgat

SEQ ID NO: 234634 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgaatgcttgatctcctgtcgactctgcgctgagactact

SEQ ID NO: 234635 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccttttcgttcacctgtgcacaccgcaaagctggtcgttt

SEQ ID NO: 234636 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctttcagggcccaatgccgcattatcatcctatgttctg

SEQ ID NO: 234637 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccttgccatggcattcccgtctcgacctatcgactgtgca

SEQ ID NO: 234638 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccttctacgtcgcaggacgtctttcgtgcactacacgatt

SEQ ID NO: 234639 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccttccagggcccaatgccgcatcatcatcctatgttctg

SEQ ID NO: 234640 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccttccagggcccaacgccgcattatcatcctatgttctg

SEQ ID NO: 234641 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccttatcgtccgaggacgtctttcgtgcactatcacgatt

SEQ ID NO: 234642 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctgtcttcgtccactcttttcggatcctgcatacaggta

SEQ ID NO: 234643 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctgataattacttcgggactacccgattacctaattttt

SEQ ID NO: 234644 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcttatccggcaggacgtctttcgtgcactatcacgat

SEQ ID NO: 234645 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctctgtccgtcccggtcgcatcacaaagatcttactggc

SEQ ID NO: 234646 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgtatcttccggtaattaccacatacgtacacgtctg

SEQ ID NO: 234647 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgtatctcccggtaattaccacgtacgtacatgtctg

SEQ ID NO: 234648 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgtacctcccggtaattaccacgtacgtacatgtctg

SEQ ID NO: 234649 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcggattcctctatggcgcgcttgccggcttactctcg

SEQ ID NO: 234650 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcggacttctcttctcgttacgtaacacgctatagcag

SEQ ID NO: 234651 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcggaccttctgctagctgatggcatgtcattcgttta

SEQ ID NO: 234652 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgcctccgttcggatccgtgcatgcacacgatgttag

SEQ ID NO: 234653 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgcatcttccggtaattaccacgtacgtacatgtctg

SEQ ID NO: 234654 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgattctctgagctacccgcggtagtaaatcgtatgc

SEQ ID NO: 234655 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgatccccttttgcgcctaggcctgcattcgaatgca

SEQ ID NO: 234656 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgatccccttttacgcctaggcctgcattcgaatgca

SEQ ID NO: 234657 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgatacctcgctttgcatgcaaaaagctacgtatggc

SEQ ID NO: 234658 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgatacctcgctttgcaatgcaaaaactacgtatggc

SEQ ID NO: 234659 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgaatcttccggtaattaccacgtacgtacatgtctg

SEQ ID NO: 234660 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcctcgaacactgacgtcgtggaaccttcgattgctag

SEQ ID NO: 234661 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctattgcatgcatatgctagacacgtccaacattgctgg

SEQ ID NO: 234662 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctagtgatttcgccgcccctctgtttagtggccattgga

SEQ ID NO: 234663 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctaggctttcacgcacgcggattgtacccgaactgggtt

SEQ ID NO: 234664 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctaggcgccttgagcttccccaggtgtgccaccaatgtt

SEQ ID NO: 234665 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgttcctcgtctccaatgcattgcactgtatacagtaaa

SEQ ID NO: 234666 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgtcgtgattttcggatccactcacagaaatttctga

SEQ ID NO: 234667 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgattagctagtcgtgctttgtccgctatgacattca

SEQ ID NO: 234668 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcagctagttgtgctttgtccgctatgacattca

SEQ ID NO: 234669 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcagctagtcgtgctttgcccgctatgacattca

SEQ ID NO: 234670 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
ccgtgatcagctagtcgtgccttgtccgctatgacattca

SEQ ID NO: 234671 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcagctagtcgtactttgtccgctatgacattca

SEQ ID NO: 234672 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatagctcagtcgtgctttgtccgctatgacattca

SEQ ID NO: 234673 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtcttcccgtgtcgacatgtactgtctgggccgcaatc

SEQ ID NO: 234674 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtctcgtctgcgatcctcaggtgtggcctcactcccaa

SEQ ID NO: 234675 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtctcggttgtcgtctcttgcaagactacttgcttatg

SEQ ID NO: 234676 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtctcggattctatacatgtatagatctgtcctgccgg

SEQ ID NO: 234677 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtcctcgcgtcgtgtacacgaagacctccggagatttg

SEQ ID NO: 234678 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtcctcaggttccctaacgcgtttagccttccggaata

SEQ ID NO: 234679 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtcaccccgatagtcatcttcactggacacccgtgtta

SEQ ID NO: 234680 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtacttgtcgcacctcgtactcagcggctgacgctatt

SEQ ID NO: 234681 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtacttgtcacacctcgtacttggcggctgacgctatt

SEQ ID NO: 234682 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtacctgtcgcacctcgtacttggcggctgacgctatt

SEQ ID NO: 234683 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtacctgtcgcacctcgtactgggcggctgacgctatt

SEQ ID NO: 234684 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtaccccgatagtcatcttcactggaccacccgtgcta

SEQ ID NO: 234685 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtaaatcctccatgcgcgcgcacggatcctgtactgca

SEQ ID NO: 234686 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccggtttcttctcctgactacatgagattaataaacgcgc

SEQ ID NO: 234687 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccggttcgtttcctctgtgttcgcacgttctccgtctgta

SEQ ID NO: 234688 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgggtctttatgtcgtctttgtaaggactacctgcatca

SEQ ID NO: 234689 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccggctcgaagattagccgtcccacaagcttgcacttcac

SEQ ID NO: 234690 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccggcctcgaacactgacgtcgtggaaccttcgatgctag

SEQ ID NO: 234691 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccggcaccccgatagtcatcttcactggaccacccgtgta

SEQ ID NO: 234692 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcttcttgccttcgagtaggggaattcacttacgtttg

SEQ ID NO: 234693 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcgccccgatagtcatcttcactggaccacccgtgtta

SEQ ID NO: 234694 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttttcctctattcttcgaagaatgccactcggatg

SEQ ID NO: 234695 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttttcctctattcttcgaagaatgccactcgaatg

SEQ ID NO: 234696 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctttggtccttacgtctagacggggtttgtgtacag

SEQ ID NO: 234697 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctttggtcccccattgtttacgcgtaactagtgaaa

SEQ ID NO: 234698 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttgtcttcgtgcctgccctctcggacctaatttta

SEQ ID NO: 234699 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttggtcctcaggtaacgttatatccgtcacgcatg

SEQ ID NO: 234700 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttggtccccattagctagctagatacacgtgtgaa

SEQ ID NO: 234701 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttggtccccaccagctagccagatacacgtgtgaa

SEQ ID NO: 234702 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttggtcatcccttacatgtaggcctatgtctgaca

SEQ ID NO: 234703 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttggtcatcccctacatgtaggcctatgtctggcg

SEQ ID NO: 234704 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttggacctcgttgcatgcaagaatacgaaagagta

SEQ ID NO: 234705 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttgattttcctgtagctacatatcttccggaatgc

SEQ ID NO: 234706 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttgatccttgaagcgcttgtggattctcgctctaa

SEQ ID NO: 234707 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttgatcctctaatgtcattgggcatcgtgactggc

SEQ ID NO: 234708 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttgatcatccaaataagcttacgagtactactctg

SEQ ID NO: 234709 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttcggtccttattgcaatcgcgcggtgatctctga

SEQ ID NO: 234710 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttcgcgtcgtgtacacgaagacctccggagatttg

SEQ ID NO: 234711 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttcgaggttccctaacgcgttagccttccggaatg

SEQ ID NO: 234712 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttcaggttctcctaacgcgttagccttccggaatg

SEQ ID NO: 234713 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttcaggtccccctaacgcgttagccttccggaatg

SEQ ID NO: 234714 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttcacctctctcttgcgcaggatgtgagcggattg

SEQ ID NO: 234715 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctgggatcactctctgcgcgtataaatgctctgtca

SEQ ID NO: 234716 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctggatcactctcttacgcgtataaatgctctgtca

SEQ ID NO: 234717 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctctttcctcttattggccactgcggtgcaccgcga

SEQ ID NO: 234718 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctctttccctctggccaacctcggatcacaacaaac

SEQ ID NO: 234719 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcttgttccctcgatctagatcgcgtcttactagg

SEQ ID NO: 234720 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcttgcctcagcaaagtagcccctatgtgcactaa

SEQ ID NO: 234721 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcttcttgcaccgcgcgcgttttattaatcgtctg

SEQ ID NO: 234722 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctctgtcgttctctactaccgccggtaattgtactg

SEQ ID NO: 234723 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctctgtcccttgcacgtgcgcgtacacagttctagc

SEQ ID NO: 234724 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctctgtcaaagggttaacccatcctgatagtacgat

SEQ ID NO: 234725 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctctgcttctccaagaatcttctccctctaccggta

SEQ ID NO: 234726 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctctgctctccctctcggatcgcgtacgtggatatg

SEQ ID NO: 234727 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctctagcctccttgtaacctctccctaatgcgtctg

SEQ ID NO: 234728 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctctagcctccatgtaatctctccctgatgcgtctg

SEQ ID NO: 234729 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgtgcaccctcctcgcattagcttccacgttctg

SEQ ID NO: 234730 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcggtgtctcttcttcgtccttcgctatagcgtaa

SEQ ID NO: 234731 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcggatcgttcccaatggtggtgcccctattaatg

SEQ ID NO: 234732 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcggatcgttcccaatggtggtgcccccattaatg

SEQ ID NO: 234733 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcggatcgttcccaatggtggtacctctattaatg

SEQ ID NO: 234734 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcggatcgttcccaatggtggtaccctacttaatg

SEQ ID NO: 234735 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcggatcgttcccaatggtggtacccctgttaatg

SEQ ID NO: 234736 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcggatcgttcccaatggtggtacccctattgatg

SEQ ID NO: 234737 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcggatcgttcccaatggtggtacccctattagtg

SEQ ID NO: 234738 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcggatcgttcccaatagtggtacccctattaatg

SEQ ID NO: 234739 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcggatcgttcccaaaggtggtacccctattaatg

SEQ ID NO: 234740 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcggatcattcccaatggtggtacccctattaatg

SEQ ID NO: 234741 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgcgtcttccgcacgattgttaacatgtgcacga

SEQ ID NO: 234742 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgcgtcgtgtacacgaagaccttccggagatttg

SEQ ID NO: 234743 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgcgtcgtgtacacgaagacctccggagatttta

SEQ ID NO: 234744 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgcgtcgtgtacacgaagacctccggagatttcg

SEQ ID NO: 234745 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgcgtcgtgtacacgaagacctccggagattctg

SEQ ID NO: 234746 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgcgccgtgtacacgaagacctccggagattttg

SEQ ID NO: 234747 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgccttaagttgcaacgttaatatctctcaacta

SEQ ID NO: 234748 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgcatctgaatgctccctgacattggtacgtacg

SEQ ID NO: 234749 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgcacacgcacgtgcaccactttccctcgtacga

SEQ ID NO: 234750 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgatttcttctcaagcagtactgttaaggcgtga

SEQ ID NO: 234751 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgatcctttataggtccttaccacaacctgtctg

SEQ ID NO: 234752 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgatccacatacaggctgacctgttcttttcgtc

SEQ ID NO: 234753 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgagtcctcacatacagatctgattgggccctat

SEQ ID NO: 234754 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgagtcatcccgtggcccgggcataacggaacta

SEQ ID NO: 234755 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaatactgacgtcgtggaaccttcgattgctag

SEQ ID NO: 234756 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacacttgacgtcgtggaaccttcgatgctag

SEQ ID NO: 234757 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactggcgtcgtggaaccttcaattgctag

SEQ ID NO: 234758 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactggcgtcgtggaacctccgattgctag

SEQ ID NO: 234759 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtggtggaaccttcgattgctag

SEQ ID NO: 234760 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcttggaaccttcgattgctag

SEQ ID NO: 234761 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgtggtaccttcgattgctag

SEQ ID NO: 234762 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgtgggacctccgattgctag

SEQ ID NO: 234763 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgtggaaccttctattgctag

SEQ ID NO: 234764 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgtggaaccttcgattgctgg

SEQ ID NO: 234765 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgtggaaccttcgattgctaa

SEQ ID NO: 234766 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgtggaacctccaattgctag

SEQ ID NO: 234767 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcggggaaccttcgattgctag

SEQ ID NO: 234768 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgcgggaccttcgattgctag

SEQ ID NO: 234769 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgcggaaccttcgattgctag

SEQ ID NO: 234770 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcatggaaccttcgattgctag

SEQ ID NO: 234771 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacacggacgtcgtggaaccttcgattgctag

SEQ ID NO: 234772 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacaatgacgtcgtggaacctttgattgctag

SEQ ID NO: 234773 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctccttcctccatgagcatgcttacttgggatactg

SEQ ID NO: 234774 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctccttcctccatgagcatgcttactcggaatactg

SEQ ID NO: 234775 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctccttcctccatgagcatgctcactcgggatactg

SEQ ID NO: 234776 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctccgttcgcctttcggatcctggtatgctgcccaa

SEQ ID NO: 234777 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctccgtctgatggaaattcgaattctgttacgtctg

SEQ ID NO: 234778 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctccgtcctttcaccctagggtaatagaaccggacg

SEQ ID NO: 234779 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctccgtcctttcaccctagggtaatagaaccggaca

SEQ ID NO: 234780 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctccaggttcccctaacgcgttagccttccggaata

SEQ ID NO: 234781 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcatgtcctcggttgctctcgtccattgctctgta

SEQ ID NO: 234782 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcagttcgcacgatatcgtggacgcatgcatgaca

SEQ ID NO: 234783 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcagtcttttcccgtgcgccttcctcttctgtgcg

SEQ ID NO: 234784 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcagtctataccggtatgtccagagctcatgtgac

SEQ ID NO: 234785 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcagtcctggtggtaccacgacgcattgctctttt

SEQ ID NO: 234786 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcagtcctggtggtaccacaacgcattgctcttct

SEQ ID NO: 234787 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcagtcctggtggtaccacaacgcatcgctctttt

SEQ ID NO: 234788 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcagtccgtggatccactttgcacgtgctatgaca

SEQ ID NO: 234789 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcagtccgtggacccactttgcacgtgccatgaca

SEQ ID NO: 234790 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcagtcaacttgcaaggatcgcccattgcactgta

SEQ ID NO: 234791 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggtttcccctaacgcgttagccttccggtatg

SEQ ID NO: 234792 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcctctaacgcgttagcccttccggaatg

SEQ ID NO: 234793 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttccctaacgcggttagccttccggaattg

SEQ ID NO: 234794 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaagcgcgttagccttccggaatg

SEQ ID NO: 234795 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaactgcgtaagccttccggaatg

SEQ ID NO: 234796 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacggcgttagccttccggaatg

SEQ ID NO: 234797 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgttgacgcttccggaatg

SEQ ID NO: 234798 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
ccgcctcaggttcccctaacgcgttaggccttccggaatg

SEQ ID NO: 234799 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgttagccttcgtagaatg

SEQ ID NO: 234800 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgttagccttccggaatgc

SEQ ID NO: 234801 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgttagccttccggaagtg

SEQ ID NO: 234802 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgttagccttccggaaatg

SEQ ID NO: 234803 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgttagccttccgaagtga

SEQ ID NO: 234804 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgttagccctccggaatgc

SEQ ID NO: 234805 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgttagccctccggaatcg

SEQ ID NO: 234806 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgttacgccttccgggatg

SEQ ID NO: 234807 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgttaagccttccggaatg

SEQ ID NO: 234808 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcggttagccttccggaatg

SEQ ID NO: 234809 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgacgttagccttccggaatg

SEQ ID NO: 234810 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaaccgtcgtacgcttccggaatg

SEQ ID NO: 234811 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaaccgcgttagccttccgaaatg

SEQ ID NO: 234812 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaaccgcgttagccctccggaatg

SEQ ID NO: 234813 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacagtcgatcgcttccggaatg

SEQ ID NO: 234814 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttccccctaacgcgttagccttccgaaatg

SEQ ID NO: 234815 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttccccaaacgcgttagccttccggaactg

SEQ ID NO: 234816 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggtcccctaacgcgttacgccttccggaactg

SEQ ID NO: 234817 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggattcccctaacgcgttagccttccggaatg

SEQ ID NO: 234818 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcagcttccccctaacgcgttagccttccggaatg

SEQ ID NO: 234819 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcagattccctacccattgcgcgatgagactggta

SEQ ID NO: 234820 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcagacatcttcccgttctgcagaactaggtgaca

SEQ ID NO: 234821 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcacggttcccctaacgcgttagccttccggaatg

SEQ ID NO: 234822 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcacaactctcgggcactgcccatgctagcttgaa

SEQ ID NO: 234823 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaacccctgtttctcggatcagcacttttaaatg

SEQ ID NO: 234824 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaaacactgacgtcgtggaaccttcgattgctag

SEQ ID NO: 234825 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccctcaggttcccctaacgcgttagccttccggaatg

SEQ ID NO: 234826 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcccgggatcactctctacgcgtataaatgctctgtca

SEQ ID NO: 234827 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccactcgtaccgtccaacgcgttagccttccggaatg

SEQ ID NO: 234828 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacctcgatagtcatcttcgctggaccacccgcgtta

SEQ ID NO: 234829 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccctgatagtcatcttcgctggaccacccgcgtta

SEQ ID NO: 234830 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccctgatagtcatcttcactgggaccaccgtgtta

SEQ ID NO: 234831 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccctgatagtcatcttcactggaccacccgtgtta

SEQ ID NO: 234832 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccgatagtcatctttcactggaccacccgtgtta

SEQ ID NO: 234833 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccctaatagtcatcttcactggaccacccgtgta

SEQ ID NO: 234834 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgtatagtcatcttcactggacacccgtgtta

SEQ ID NO: 234835 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccggtagtcatcttcgctggaccacccgcgtta

SEQ ID NO: 234836 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatcatcatcttcactggaccacccgtgtta

SEQ ID NO: 234837 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatcagctcatcttcactggacaccgtgtta

SEQ ID NO: 234838 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagttcatcttcactggacacccgtgtta

SEQ ID NO: 234839 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcgtcttcgctggactacccgtgtta

SEQ ID NO: 234840 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcgtcttcgctggaccgcccgtgtta

SEQ ID NO: 234841 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcgatcttcactggacacccgtgtta

SEQ ID NO: 234842 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatctttcactggacaccagtgtta

SEQ ID NO: 234843 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttgcactggacacccgtgtta

SEQ ID NO: 234844 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcgctggacacccgtcgtta

SEQ ID NO: 234845 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggaccacgctcataa

SEQ ID NO: 234846 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggaccacccgtgttg

SEQ ID NO: 234847 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggaccacccgtgtca

SEQ ID NO: 234848 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggaccacccgcgtta

SEQ ID NO: 234849 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggaccacccatgtta

SEQ ID NO: 234850 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggaccaccagtgtta

SEQ ID NO: 234851 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggacacccgtgttga

SEQ ID NO: 234852 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactgaaccacccgtgtta

SEQ ID NO: 234853 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcaactggacacccgtgtta

SEQ ID NO: 234854 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatctccgctggaccacccgcgtta

SEQ ID NO: 234855 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatccttcactggacacccgtgtta

SEQ ID NO: 234856 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcaccttcactggaccacccgtgtta

SEQ ID NO: 234857 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagctcatcttcactggaccaccgtgata

SEQ ID NO: 234858 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagctcatcttcactggacacccgtgtta

SEQ ID NO: 234859 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagccatcttcactggaccacccgtgtta

SEQ ID NO: 234860 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgactagtcatcttcactggacacccgtgtta

SEQ ID NO: 234861 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgacagtcatcttcactggaccacccgtgttg

SEQ ID NO: 234862 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtcatcttcgctggaccaccgcgtta

SEQ ID NO: 234863 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtcatcttcactggaccaccgtgtta

SEQ ID NO: 234864 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccaatagtcatcttcactggaccacccgtgtta

SEQ ID NO: 234865 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacagctcacttcgtctttgatcgactacgctcataa

SEQ ID NO: 234866 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacagctcacttcgtctttgatcgaccacgctcatga

SEQ ID NO: 234867 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacagctcacctcgtctttgatcgaccacgctcataa

SEQ ID NO: 234868 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgagcacccctgatagtctcttcgctggaccaccgtgta

SEQ ID NO: 234869 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgacctcaggttcccctaacgcgttagccttccggaatg

SEQ ID NO: 234870 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgacctcaggttcccctaacacgttagccttccggaatg

SEQ ID NO: 234871 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccttatccggcaggacgcctttcgtgcactatcacgatt

SEQ ID NO: 234872 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccctgcaataatcccgggacagtgccgcggaatgtctgcg

SEQ ID NO: 234873 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccctctatagttgtcggcgtagcacgctattgcttagaag

SEQ ID NO: 234874 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccctctatagtcgtcggcgtagcacgatattgcttagaag

SEQ ID NO: 234875 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccctctatagtcgtcggcgtagcacactattgcttagaag

SEQ ID NO: 234876 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccctatccccatcgagcgatcgtcgtagtactgcttccaa

SEQ ID NO: 234877 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgtctcgatcctacttttcgaaaggtctattacgctaa

SEQ ID NO: 234878 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgtagtccttctccaaacggagccgaaattcggtacca

SEQ ID NO: 234879 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgtagtccttctccaaacggagccgaaactcggtacta

SEQ ID NO: 234880 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccggtcttctcttctcggatcaaaaactgcttaagcata

SEQ ID NO: 234881 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccggtcttctcttctcggaccaaaaactgcttaagcata

SEQ ID NO: 234882 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccggcgcctcggatctcttacgttccggaactgttgcaa

SEQ ID NO: 234883 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccggacatcccgcctcgtaacacctattaccgtttgctg

SEQ ID NO: 234884 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgctatttccctgacctcccgcttgcaatgctggcatt

SEQ ID NO: 234885 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgcgtgcaagtacttggatgttgtagagcgcctcgaca

SEQ ID NO: 234886 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgcctctgttctcttactaacgttagaaagtcttacgt

SEQ ID NO: 234887 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgcctcgatattcgaatctagattggactcctcgtttg

SEQ ID NO: 234888 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgcaggccatgctctagacgcctcaaaaagatgatgct

SEQ ID NO: 234889 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgcacgggtggcccctctgtatgaatggtaccgctata

SEQ ID NO: 234890 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgcaccccgatcagtcatcttcactggacacccgtgta

SEQ ID NO: 234891 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgcaccccgatagtcatcttcactgaccacccgtgtta

SEQ ID NO: 234892 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccccgtatcccgcttgtgatatcacacacaattcgtactg

SEQ ID NO: 234893 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccccgcaagccatgctctagacgctcaaaaggatgatgct

SEQ ID NO: 234894 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccccctatagtcgtcggcgtagcacgctattgcttagaag

SEQ ID NO: 234895 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccccaagacgattgtcgttattgccggactacctgcattt

SEQ ID NO: 234896 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccatgatttcctcctacctgggtaccgcgcgttgctacg

SEQ ID NO: 234897 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccatgatttcctcctacatgggtagccgcgcgttgctag

SEQ ID NO: 234898 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccactccgatcctcaagtccgatcctcccttcgtttggc

SEQ ID NO: 234899 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccatttaaatggctgcccctctgtgttacggccgtaaata

SEQ ID NO: 234900 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtggcgcttatggagccgggtaccttccagcaagg

SEQ ID NO: 234901 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtgctgcttatggagccggtaccttccagcaatgg

SEQ ID NO: 234902 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtgcgcttcatggagccgggtaccttccagcaagg

SEQ ID NO: 234903 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtgcgcttatggagccgggtaccttccagcaatgg

SEQ ID NO: 234904 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtgcgcttactggagccgggtaccttccagcaagg

SEQ ID NO: 234905 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccatctggaaccccggtcatcgtcggagactactccgttg

SEQ ID NO: 234906 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccagttcattgactactttgatgttacgtgctaagcatac

SEQ ID NO: 234907 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccacctcggtcctgctgcacgagctagctagtgagaaccg

SEQ ID NO: 234908 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccaccattctcggattttctagctagaacgcacctcctca

SEQ ID NO: 234909 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccacacccccgatagtcatcttcactggacacccgtgtta

SEQ ID NO: 234910 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccaagcgttggtgtataacagccatccttatcccttggcg

SEQ ID NO: 234911 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccaaaagttctcggatctcgcattggtgcacgacctccaa

SEQ ID NO: 234912 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattttctaggcctacgccgcccgggctcctccgtatgcg

SEQ ID NO: 234913 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catttggaaacagcgactcgtttataccggttcgcctcca

SEQ ID NO: 234914 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattgttcattctcggagaccccccgtgcacgtgctagta

SEQ ID NO: 234915 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattgtggacctcctttctcggatccaaacacaattgtac

SEQ ID NO: 234916 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattgtggacctcctttctcgatccaaacacaatttgcac

SEQ ID NO: 234917 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattgtcgcgcttatcggagccgggtaccttccagcaagg

SEQ ID NO: 234918 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattgatactcctgttctcgcgtttacctccctgtgcgca

SEQ ID NO: 234919 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattcgccagtcacatcaactatgatgacgcttgactggg

SEQ ID NO: 234920 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattatccgtttgtccgtcctctcgtggtattgcgcatgc

SEQ ID NO: 234921 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattagctacactccttgcatgcaagactggacgcgcgat

SEQ ID NO: 234922 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catggttaactcgttcccgcctgggtcctccggatccgca

SEQ ID NO: 234923 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catggggcttttaagcacttctcggtaacttgggcagtta

SEQ ID NO: 234924 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catggggcttttaagcacttcccgtaacttgggcagttac

SEQ ID NO: 234925 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catgcggtttcttctgacgctagcgactttgaccggctcc

SEQ ID NO: 234926 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
catgcgagtatccgccttgctcctctggtcgatgtacgta

SEQ ID NO: 234927 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catgcaccattggctccaagtgattgatataccaagtctg

SEQ ID NO: 234928 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catgatatatcacaacgcctcagtcgctactcggtctacc

SEQ ID NO: 234929 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catcttcctggtacagtaccaatcatcgtcttttcgcgcg

SEQ ID NO: 234930 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctggtgatcaccgaaccaacccattctctcggtattg

SEQ ID NO: 234931 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctctcggttcccgtgcgcacgcagctgactcgaactg

SEQ ID NO: 234932 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctctcgggtcctattgttcgcgcgtcccccctgtata

SEQ ID NO: 234933 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctctcggctctcgtgcgcacgcagctgactcgaactg

SEQ ID NO: 234934 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctctcggctcccgtgtgcacgcagctgactcgaactg

SEQ ID NO: 234935 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctctcggctcccgtgcgcgcgcagctgactcgaactg

SEQ ID NO: 234936 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctctcggctcccgtgcgcacgcggctgactcgaactg

SEQ ID NO: 234937 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctctcggctcccgtgcgcacacagctgactcgaactg

SEQ ID NO: 234938 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctctcggacgtcattcctgcctcgttcctctcgtttg

SEQ ID NO: 234939 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctcaaccctccactacatctgttcttgcacgcctgac

SEQ ID NO: 234940 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctatccgtttgtcctcctcttgtggtattgcgcatgc

SEQ ID NO: 234941 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catcggagtctgcctatcatgcgccatcatgttgtcagga

SEQ ID NO: 234942 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catccggattcgcatctttctttaccatcatctacgtaga

SEQ ID NO: 234943 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catccgccagtcacatcaactatgatgacgcttgactgga

SEQ ID NO: 234944 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catcacaagtcgaacgtgctcactctcgatggccatgtca

SEQ ID NO: 234945 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catatctcccgttgtgatcacgacttatcattcgcgtctg

SEQ ID NO: 234946 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cataagcaacatgatggaaatgctagccttctccatgccg

SEQ ID NO: 234947 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cataaacaacatgatggagatgctagccttctccatgccg

SEQ ID NO: 234948 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagtttacctctctctcggatcgtaattgcccgcaagata

SEQ ID NO: 234949 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagttgtactcgagtgctgtcgcctgggcacctccaggat

SEQ ID NO: 234950 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagtgcttgatctcctgtcggctctgcggctgagactact

SEQ ID NO: 234951 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagtgcttgatctcctgtcgactctgcggctgagactact

SEQ ID NO: 234952 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caggtgtgcatatctcccgcctcgctccttaaggaactta

SEQ ID NO: 234953 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caggatgcgttttctctcgcctctgttctcccggacgctt

SEQ ID NO: 234954 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagctgacgtctcgatccatccccgacacgtacgtgaatt

SEQ ID NO: 234955 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagcggtcgcagctgcagttgccgccttatcctccgtctg

SEQ ID NO: 234956 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagccgcctcatacactccactcggatcacatcgccgcca

SEQ ID NO: 234957 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagccgcctaatacactccactcggatcacatcgccgcca

SEQ ID NO: 234958 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagccaatgttcatcgagcgagttatattattgcataacg

SEQ ID NO: 234959 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagcaccccgatagtcatcttcgctggaccacccgtgtta

SEQ ID NO: 234960 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagatctgctcagccttggtccgccttagtacgccggcta

SEQ ID NO: 234961 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagatacggattgtcggttgctcgctatagcatcgaacgg

SEQ ID NO: 234962 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagatacggattgtcggttgctcactatagcatcgaacgg

SEQ ID NO: 234963 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagaacgaagtctcccaagtgtgtcgttcgaattgccgct

SEQ ID NO: 234964 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagaaagatctttttgagcctcgaaatgctgatatattag

SEQ ID NO: 234965 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactttataaccctgtcgcctcgattgtccccgtcctacc

SEQ ID NO: 234966 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacttatccgacaggacgtctttcgtgcactatcacgatt

SEQ ID NO: 234967 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactgtccgtttgtccgtcctctcgtggtattgcgcatgc

SEQ ID NO: 234968 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactgtccgtttgtccgtcctcctgtggtattgcgcatgc

SEQ ID NO: 234969 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactgtccgtagatccgtcactcactacgcgtatggaatc

SEQ ID NO: 234970 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactcgccagtcacatcaactatgatgacgcttggctgga

SEQ ID NO: 234971 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactccgtcagaagatcgttcgtggggccctatccccttc

SEQ ID NO: 234972 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactattaccgtttggagcgctatctccgtcgatacggta

SEQ ID NO: 234973 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatctgtttgtccgtcctctcgtggtattgcgcatgc

SEQ ID NO: 234974 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatctgtcatcgagcgagcactttgtgcgatcacaca

SEQ ID NO: 234975 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatctgtatcgagcgttgtcaacaagcggctaaggcc

SEQ ID NO: 234976 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatctgcatcgagcgtaagtggtaccaaaataaccgt

SEQ ID NO: 234977 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcctcatcgatgctgagttatacgcctacgagggg

SEQ ID NO: 234978 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtttgtcctcttgtggtattgcgcatgc

SEQ ID NO: 234979 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtctcgtcctcttggtgtatgcgcatcg

SEQ ID NO: 234980 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtgctcttgtggtattgcgcatgc

SEQ ID NO: 234981 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcttcttgtagcattgcgcatgc

SEQ ID NO: 234982 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcttctcgtggtgttgcgcatgc

SEQ ID NO: 234983 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcgtcttgtggtattgcgcatgc

SEQ ID NO: 234984 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccttttgtggtattgcgcatgc

SEQ ID NO: 234985 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtgttattgcgcatgc

SEQ ID NO: 234986 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtgttgcgcgtgc

SEQ ID NO: 234987 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtgctgcgcatgc

SEQ ID NO: 234988 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgggcatgc

SEQ ID NO: 234989 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgtacgc

SEQ ID NO: 234990 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcatgg

SEQ ID NO: 234991 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcatcg

SEQ ID NO: 234992 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcacac

SEQ ID NO: 234993 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcaagc

SEQ ID NO: 234994 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtatgcgcatcgc

SEQ ID NO: 234995 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtatagcgcatgc

SEQ ID NO: 234996 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtcgtattgcgcatgc

SEQ ID NO: 234997 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgcggtaatgcgcatgc

SEQ ID NO: 234998 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgaggcattgcgcatgc

SEQ ID NO: 234999 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttctggtattgcgcatgc

SEQ ID NO: 235000 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttcgtggtattgcgctgc

SEQ ID NO: 235001 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctgtggtattgcgtcatgc

SEQ ID NO: 235002 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctgtcggtattgcgcatgc

SEQ ID NO: 235003 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgtgcatgc

SEQ ID NO: 235004 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgcgcgtgc

SEQ ID NO: 235005 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgcgcatgt

SEQ ID NO: 235006 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgcgcatgg

SEQ ID NO: 235007 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgcgcaggc

SEQ ID NO: 235008 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgcgcaagc

SEQ ID NO: 235009 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgcgcaaac

SEQ ID NO: 235010 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgcacatgc

SEQ ID NO: 235011 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattacgcatgc

SEQ ID NO: 235012 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtaatgcgcatgc

SEQ ID NO: 235013 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcggggtattgcgcatgc

SEQ ID NO: 235014 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctagtggtgttgcgcatgc

SEQ ID NO: 235015 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctagtggtatcgcgcatgc

SEQ ID NO: 235016 - skipped

SEQ ID NO: 235017 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggtattgcgcatac

SEQ ID NO: 235018 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggtattgagcatgc

SEQ ID NO: 235019 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggtattacgcatgc

SEQ ID NO: 235020 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcatgtggtattgcgcatgc

SEQ ID NO: 235021 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctatcgtggtattgcgcatgc

SEQ ID NO: 235022 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccgcttgtggtattgcgcatgc

SEQ ID NO: 235023 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcccctcgtggtattgcgcatgc

SEQ ID NO: 235024 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccactcgtggtattgcgcatgc

SEQ ID NO: 235025 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccatcctctcgtggtattgcgcatgc

SEQ ID NO: 235026 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtacgtcctctcgtggtattgcgcatgc

SEQ ID NO: 235027 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgcccgtcctcttgtggtattgggcatgc

SEQ ID NO: 235028 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgcccgtcctcttgtggtattgcgcgtgc

SEQ ID NO: 235029 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgcccgtcctcttgtggtattgcgcacgc

SEQ ID NO: 235030 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgcccgtcctcctgtggtattgcgcatgc

SEQ ID NO: 235031 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgatctcgtctctccctctcaggcaaccg

SEQ ID NO: 235032 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtctcttgtggtattgacgcatagc

SEQ ID NO: 235033 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtacttgcgcatgc

SEQ ID NO: 235034 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttcgtggtattgcgcatgc

SEQ ID NO: 235035 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctctcgtggtattgcgtcatgc

SEQ ID NO: 235036 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgatcctcttgtggtatgcgtcacgc

SEQ ID NO: 235037 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttggtccgtcctcttgtggtattgcgcatgc

SEQ ID NO: 235038 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttcgtccgtcctctcgtggtattgcgcatgc

SEQ ID NO: 235039 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttcgtccgtcctcctgtggtattgcgcatgc

SEQ ID NO: 235040 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtgtgtccgtcctcttgtggtattgcgcatgc

SEQ ID NO: 235041 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtggatccgtcactcactacgcgtatggaatc

SEQ ID NO: 235042 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtcttaacgtgttcccttcggacgtccatcaa

SEQ ID NO: 235043 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtcttaacgtgttccctccggacatccatcaa

SEQ ID NO: 235044 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtcttaacgtgtccccttcggacatccatcaa

SEQ ID NO: 235045 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtcttaacgtgctcccttcggacatccatcaa

SEQ ID NO: 235046 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtcttaacgtgctccctccggacatccatcaa

SEQ ID NO: 235047 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtccccttgtggtattgcgcatgc

SEQ ID NO: 235048 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtccgtccgtcctcttgtggtattgcgcatgc

SEQ ID NO: 235049 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtgaacgagcggctaaggcc

SEQ ID NO: 235050 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcaacgggcggctaaggcc

SEQ ID NO: 235051 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcaacgagcggctaagacc

SEQ ID NO: 235052 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcaacaggcggctaaggcc

SEQ ID NO: 235053 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcaacaagcggctaaggtc

SEQ ID NO: 235054 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
cactatccgtatcgagcgttgtcaacaagcggctaaggca

SEQ ID NO: 235055 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcaacaagcggctaagacc

SEQ ID NO: 235056 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcaacaagcggccaaggct

SEQ ID NO: 235057 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcaacaaacggctaaggcc

SEQ ID NO: 235058 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgccaacaagcggctaaggcc

SEQ ID NO: 235059 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgatcgtcgtaagactgcttccaa

SEQ ID NO: 235060 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcgctcactacgcgtatggaatc

SEQ ID NO: 235061 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcgctacgcgtatggaatc

SEQ ID NO: 235062 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactccctacgcgtatggaatc

SEQ ID NO: 235063 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcactgcgcgtatggagtc

SEQ ID NO: 235064 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcactatgtgtatggaatc

SEQ ID NO: 235065 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcactactgcgtatgaatc

SEQ ID NO: 235066 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcactacgtgtatggaatc

SEQ ID NO: 235067 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcactacgcgtatgtaatc

SEQ ID NO: 235068 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcactacgcgtatggagtc

SEQ ID NO: 235069 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcactacgagtatggaatc

SEQ ID NO: 235070 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcactacacgtatggaatc

SEQ ID NO: 235071 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcaccacgcgtatggaatc

SEQ ID NO: 235072 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcacccactacgcgtatggaatc

SEQ ID NO: 235073 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagacccgtcactcactacgcgtatagaatc

SEQ ID NO: 235074 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccggttgtccgtcctcttgtggtattgcgcatgc

SEQ ID NO: 235075 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccggtcaggacgtctttcgtgcactatcacgatt

SEQ ID NO: 235076 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtctgtcctctcgtggtattgcgcatgc

SEQ ID NO: 235077 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtggtgttgcgcgtgc

SEQ ID NO: 235078 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtggtgttgcgcatgc

SEQ ID NO: 235079 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtggtattgcgcatac

SEQ ID NO: 235080 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtggtattgcgcacgc

SEQ ID NO: 235081 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctctggtggtattgcgcatgc

SEQ ID NO: 235082 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctctcgtggtattgcgcatac

SEQ ID NO: 235083 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcctgtggtattgcgcatgc

SEQ ID NO: 235084 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccatcctcttgtggtattgcgcatgc

SEQ ID NO: 235085 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgcccgtcctcttgtggtattgcgcatgc

SEQ ID NO: 235086 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttatgttcgcctttctctcggttgcgcgtt

SEQ ID NO: 235087 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttatgttcgcctccctctcggttgcgcgtt

SEQ ID NO: 235088 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttatgttcacctctctctcggttgcgcgtt

SEQ ID NO: 235089 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgctcgtccgtcctcctgtggtattgcgcatgc

SEQ ID NO: 235090 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcgatcgagcgaatcgcattataaatcgcatg

SEQ ID NO: 235091 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcgatcgagcgaatcgcatcataagtcgcatg

SEQ ID NO: 235092 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcgatcgagcgaatcgcatcataaaccgcatg

SEQ ID NO: 235093 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgccatcgagcggacagtgtgccgttttcggtg

SEQ ID NO: 235094 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgccatcgagcgaacagtgtgccgttttcggtg

SEQ ID NO: 235095 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcatggagcgggttcttcgataatatgcagca

SEQ ID NO: 235096 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcatcgagctttcgtccgggagtgtgtagcta

SEQ ID NO: 235097 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcatcgagcgggttcttcgataatatgcaaca

SEQ ID NO: 235098 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcatcgacgcgttagtcttgctgtcatgcggc

SEQ ID NO: 235099 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcatcgacgcgttagtctcgctgtcatgcagc

SEQ ID NO: 235100 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcatcgacgcgttagtcctgctgtcatgcagc

SEQ ID NO: 235101 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgacgtcgagagagctacgtcatcaagcgctaa

SEQ ID NO: 235102 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgacatcgagagggctacgtcatcaagcgctaa

SEQ ID NO: 235103 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgacatcgagagagttacgtcatcaagcgctaa

SEQ ID NO: 235104 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgacatcgagagagctgcgtcatcaagcgctaa

SEQ ID NO: 235105 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgacatcgagagagctccgtcatcaagcgctaa

SEQ ID NO: 235106 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgacatcgagagagctacgtcgtcaagcgctaa

SEQ ID NO: 235107 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgacatcgagagagctacgtcattaagcgctaa

SEQ ID NO: 235108 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgacatcgagagagctacgtcatcaagtgctaa

SEQ ID NO: 235109 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgacatcgagagagctacgtcatcaagcgctga

SEQ ID NO: 235110 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgacatcgagagagctacgtcatcaagcgctat

SEQ ID NO: 235111 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgacatcgagagagctacgtcatcaagcgctag

SEQ ID NO: 235112 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgacatcgagagagctacgtcaacaagcgctaa

SEQ ID NO: 235113 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgaatcgagcttgagtgtctggttaaacaacga

SEQ ID NO: 235114 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcgagcggtcgtcgtaacactgcttccaa

SEQ ID NO: 235115 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcgagcgatcgtcgtaatactgctttcaa

SEQ ID NO: 235116 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcgagcgatcgtcgtaatactgcttctaa

SEQ ID NO: 235117 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcgagcgatcgtcgtaatactgcttccag

SEQ ID NO: 235118 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcgagcgatcatcgtaatactgcttccaa

SEQ ID NO: 235119 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatacgtttgtccgtcctcttgtggtattgcgcatgc

SEQ ID NO: 235120 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatacgtagatccgtcactcactacgcgtatggaatc

SEQ ID NO: 235121 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactacccgtttgtccgtcctctcatggtattgcgcatgc

SEQ ID NO: 235122 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactaaccgtttgtccgtcctctcgtggtattgcgcatgc

SEQ ID NO: 235123 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgttgaatgttatccgccctgcttccgtccctaagctg

SEQ ID NO: 235124 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgttgaacgttatccgccttgcttccgtccctaagctg

SEQ ID NO: 235125 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgttccacagtcatgactgttctcttgggttggatatc

SEQ ID NO: 235126 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgtcttccccgcattgccgcaattgccatacattaata

SEQ ID NO: 235127 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgtacgtgagattgcctcgctactctcctttgcagctg

SEQ ID NO: 235128 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgtacgtcgagattgcctcgctactctctttgcagctg

SEQ ID NO: 235129 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgtaagggtattgctggtcgccaacttcctagccgcac

SEQ ID NO: 235130 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacggattccctccttactgccgcctcaagtattcttgcg

SEQ ID NO: 235131 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgcttctcggattgttccgtcctctcctaatcgcgccg

SEQ ID NO: 235132 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgcttctcggattgttccgtcctctcctaatcgcgcca

SEQ ID NO: 235133 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgcctctatctcggatcagcaacatatgccgctacatc

SEQ ID NO: 235134 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgcctctatctcggatcagcaacaaatgccgctacatc

SEQ ID NO: 235135 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgcccgggactgtcgcgtcgaagacatgcatggcacta

SEQ ID NO: 235136 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgcagcctcggtcctacacagcatggccatgccgttat

SEQ ID NO: 235137 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgagtttcggtcaccctacgcgcaggtgtgcttgttcc

SEQ ID NO: 235138 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacctctcggacgtcatttctgcctcgttcctctcgtttg

SEQ ID NO: 235139 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccgtgactacacggatttctgcccgaatcggcaattgt

SEQ ID NO: 235140 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccggaagttcctcctcgtcttgatgcactatcatctca

SEQ ID NO: 235141 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccggaagtccttcctcgtcttgatgcactatcatctca

SEQ ID NO: 235142 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccggaacgcctcgatcctcgcataatatgatacgtctg

SEQ ID NO: 235143 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccgcggtggatgactctatcggtgactacaccgtaata

SEQ ID NO: 235144 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccgcggtggacgactctatcggtgactacaccgtaata

SEQ ID NO: 235145 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgtaatcgagcgggtacgtcaaattgcccccca

SEQ ID NO: 235146 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacattgaatgttatccgccttgcttccgtccctaagctg

SEQ ID NO: 235147 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacaatcggctcgctttcagacgcctctaatacgactgta

SEQ ID NO: 235148 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacaactcgagatcccatatcctccttgccgcttcccatg

SEQ ID NO: 235149 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgcttggtctcctgtcgactctgcggctgagactact

SEQ ID NO: 235150 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgcttgatctcctgtcgactctgcggctgaggctact

SEQ ID NO: 235151 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgcttgatctcctgtcgactctgcggctgagaactct

SEQ ID NO: 235152 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgcttgatctcctgtcgactccgcggctgagactact

SEQ ID NO: 235153 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgcttgatctcctgccgactctgcggctgagactacc

SEQ ID NO: 235154 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgcttgatctcctctcgactctgcggctgagactact

SEQ ID NO: 235155 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgcttgatctcctatcgactctgcggctgagactact

SEQ ID NO: 235156 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgcttgatatcctgtcgactctgcggctgagactact

SEQ ID NO: 235157 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgctagatcccctgtcgactctgcggctgagactact

SEQ ID NO: 235158 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatcctcacagtcgtttagaattctggttccgttccttc

SEQ ID NO: 235159 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caagtacgagatgcagctcttctctttccgcctcggttaa

SEQ ID NO: 235160 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caagatgctgaaactcgtacgacaacagcctcgttcgctg

SEQ ID NO: 235161 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caacgcttgatctcctgtcgactctgcggctgagactact

SEQ ID NO: 235162 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caacgactttcccttctcggatatcttattgccgcggcac

SEQ ID NO: 235163 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caaccggggccctgcctcaagctagctacctccattgctg

SEQ ID NO: 235164 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caaccggggcccgcctcgagctagctacctccattgtctg

SEQ ID NO: 235165 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caaccgggacccgcctcaagctggctacctccattgtctg

SEQ ID NO: 235166 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caacacttccaggtaccttgacactgcgcagtgtagtata

SEQ ID NO: 235167 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caacaaaaactgtgcactcggatcacaccttcctctctgc

SEQ ID NO: 235168 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caaatcctccggccgcttcgaaatagtacgatagtctgcg

SEQ ID NO: 235169 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caaatcctccggccgcctcgaaatagtatgatagtctgcg

SEQ ID NO: 235170 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atttgggcctcgattcttcccacataggcatgccatgtta

SEQ ID NO: 235171 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atttgaagcgcaccagctaatagcatggcccccttaactg

SEQ ID NO: 235172 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atttccgtctaacacgtgcactatcacggctttagttaga

SEQ ID NO: 235173 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attgttgcctgggctcctctctacgattgcaatcgacaaa

SEQ ID NO: 235174 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attgtgtacacactagtatgcctcgttcacttaggccgcg

SEQ ID NO: 235175 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attggtcctggggtatccgcctcgctaagtttgtgcatgc

SEQ ID NO: 235176 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attgccagctggaattgcgcctcgactgccagtgtccgga

SEQ ID NO: 235177 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attgattccagcgacttcggtggtgtcctctccattacca

SEQ ID NO: 235178 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attgagcctcgaggagatccgcctcaagctccagtctggc

SEQ ID NO: 235179 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attgaattccagcgacttcgtggtgtcctctccattacca

SEQ ID NO: 235180 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attcttgtttttaagttggcgaggtcctctaacttttggg

SEQ ID NO: 235181 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attctgttttttaagtttggcgaggtcctctaactttggg

SEQ ID NO: 235182 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
attctgttttttaagttggcggggtcctctaacttttggg

SEQ ID NO: 235183 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attctgttttttaagttggcgaggtcctctatcttttggg

SEQ ID NO: 235184 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attctgtttttaagttggcgaggctcctctaacttttggg

SEQ ID NO: 235185 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attctcgtcgccgttcaatcgactacgcttgatcatgtgg

SEQ ID NO: 235186 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attctcgcctctgtcctcatggttcgaaccggtgtgcatg

SEQ ID NO: 235187 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attctcgcctctgtcctcatggttcgaaccggtatgcatg

SEQ ID NO: 235188 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attctcgcctcctcgtccatggttcgaaccggtatgcatg

SEQ ID NO: 235189 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attctagactaagcctcttgccccctaaccggtttgcatg

SEQ ID NO: 235190 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attcgaagcgcaccagctaatagcatggcccccttaactg

SEQ ID NO: 235191 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attcccctggagtgttgagtcggtcaagcactatcttgaa

SEQ ID NO: 235192 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attcagctggagcgctatctctggcaaatgggaccgtttc

SEQ ID NO: 235193 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attatatgggcccagattcgcctccggtccaaccatatcg

SEQ ID NO: 235194 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attactggaaacgccgcctcgttctatctccggtgcaccg

SEQ ID NO: 235195 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attacagcgcccaggatgccccgtttcccgtgttcgggat

SEQ ID NO: 235196 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attacagcgcccagaatgccccgtttcccgcgttcgggat

SEQ ID NO: 235197 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attacagcgcccagaataccccgtttcccgtgttcgggat

SEQ ID NO: 235198 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attacagcgccagaatgccccgcttccccgtgttcgggat

SEQ ID NO: 235199 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgatttcggtggtgtcctctccattacca

SEQ ID NO: 235200 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttcggtggtgtcctctccattgcca

SEQ ID NO: 235201 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttcggtggtgtcctctccattacta

SEQ ID NO: 235202 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttcggtggtgtcctctccatcacca

SEQ ID NO: 235203 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttcggcggtgtcctctccattacca

SEQ ID NO: 235204 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacctcggtggtgtcctctccattacca

SEQ ID NO: 235205 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaatcccagcgacttcggtggcgtcctctccattacca

SEQ ID NO: 235206 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaataccagcgacttcggtggtgtcctctccattacca

SEQ ID NO: 235207 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaacttcagcgacttcggtggtgtcctctccattacca

SEQ ID NO: 235208 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaactccggcgacttcggtggtgtcctctccattacca

SEQ ID NO: 235209 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaactccagcgacttcggcggtgtcctctccattacca

SEQ ID NO: 235210 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaacggtacagatgcttccgcctgggttcctcctgtcg

SEQ ID NO: 235211 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgttccactgacgctctgacactatcagtgacgtctcga

SEQ ID NO: 235212 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtggcttttaagcacttctcggtaacttgggcagttac

SEQ ID NO: 235213 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtcctgacgcttctggcactatccagttgatcgactca

SEQ ID NO: 235214 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtcccattgacgctctggcactatccagttgacgctca

SEQ ID NO: 235215 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccattgagcttctggcatctatccagttgacgctca

SEQ ID NO: 235216 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccattgagctctggcatctagtccagttgacgctca

SEQ ID NO: 235217 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgagtcttctggccactatccagttgacgctca

SEQ ID NO: 235218 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgagtcttctcggcactacccagttgacgctca

SEQ ID NO: 235219 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgagcttctggtcatctatccagttgacgctca

SEQ ID NO: 235220 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgagcttctggcatcttatccagttgacgctca

SEQ ID NO: 235221 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgagcttctggcatctatccagcttgacgctca

SEQ ID NO: 235222 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgagcttctggcactatccagttgacgtctcga

SEQ ID NO: 235223 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgagcttctggcactatccagttgaacgctaca

SEQ ID NO: 235224 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgagcttacctggcactatccagttgacgctca

SEQ ID NO: 235225 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgagccttctggcacgtatccagttgacgctca

SEQ ID NO: 235226 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgacgcttctggcactatccagttgacgtctca

SEQ ID NO: 235227 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgacgcttctggacactatccagttgacgctca

SEQ ID NO: 235228 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgacgctactggacactatccagttgacgctca

SEQ ID NO: 235229 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccactgagctctggacactatcattgacgtgctcga

SEQ ID NO: 235230 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtcatatgacaactcggataccgcattgtctatgtacg

SEQ ID NO: 235231 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtcagtcgcgctgctcggccactatcccattacgctca

SEQ ID NO: 235232 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggttcatgagctattcgtgcatatccagttgacgctca

SEQ ID NO: 235233 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtggcttttaagcacttctcgtaacttgggcagttac

SEQ ID NO: 235234 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtcccatgagctctggcactatcccagttgacgctca

SEQ ID NO: 235235 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccattgggcttctggcactatccagttgacgctca

SEQ ID NO: 235236 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccattgagcttctggcgctatccagttgacgctca

SEQ ID NO: 235237 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccattgagcttctggcactatccagttgacgctcg

SEQ ID NO: 235238 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttcttggcactatccagttgacgctca

SEQ ID NO: 235239 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctgggcactatccagttgacgctca

SEQ ID NO: 235240 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcgctatcccagttgacgctca

SEQ ID NO: 235241 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcagctatccagttgacgctca

SEQ ID NO: 235242 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcacttatccagttgacgctca

SEQ ID NO: 235243 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactatcctagttgacgctca

SEQ ID NO: 235244 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactatccagttgatcgctca

SEQ ID NO: 235245 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactatccagttgacgcttca

SEQ ID NO: 235246 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactatccagttgacgctcta

SEQ ID NO: 235247 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactatccagttgacgctcga

SEQ ID NO: 235248 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactatccagttgacgctaca

SEQ ID NO: 235249 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactatccagttgacgcctca

SEQ ID NO: 235250 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactatccagttgacgcatca

SEQ ID NO: 235251 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactatccagttgaacgctca

SEQ ID NO: 235252 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactatccagcttgacgctca

SEQ ID NO: 235253 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactataccagttgacgctca

SEQ ID NO: 235254 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactaccactagctgacgcca

SEQ ID NO: 235255 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcacctatccagttgacgctca

SEQ ID NO: 235256 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcaccatccagttgaacgctca

SEQ ID NO: 235257 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcaatatccacgttgacgctca

SEQ ID NO: 235258 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcaactatccagttgacgctca

SEQ ID NO: 235259 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctgagcactatccagttgacgctca

SEQ ID NO: 235260 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagctacctggcactatccagttgacgctca

SEQ ID NO: 235261 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagccttctggcactatccggttgacgctca

SEQ ID NO: 235262 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcctctggcactatcccagttgacgctca

SEQ ID NO: 235263 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcattctggcactatccagttgacgctca

SEQ ID NO: 235264 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgacgcttctggcactatccggttgacgctca

SEQ ID NO: 235265 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgacgctctggcatctatccagttgacgctca

SEQ ID NO: 235266 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgacgctctggcactatccagttgacgtctca

SEQ ID NO: 235267 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatcgagcttctggcactatccagttgacgctca

SEQ ID NO: 235268 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccactgagcttctggcgctatccagttgacgctca

SEQ ID NO: 235269 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccactgagcttctggcactatccagttgacgctcg

SEQ ID NO: 235270 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccactgagcttctggcaccatccagttgacgctca

SEQ ID NO: 235271 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccactgagctctggccactatccagttgacgctca

SEQ ID NO: 235272 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccactgagctctgacactatccagtgacgtctcga

SEQ ID NO: 235273 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccacgagcttctggcactactccagttgacgctca

SEQ ID NO: 235274 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgggtgctttaagcacttctcggtaacttgggcagttac

SEQ ID NO: 235275 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggggcttttaagcacttctcggtaacttgagcagttac

SEQ ID NO: 235276 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgggctttaagctcacttctcggtaacttgggcagttac

SEQ ID NO: 235277 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgggagcttttaagcacttctcgtaacttgggcagttac

SEQ ID NO: 235278 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgggagctttaagcacttctcggtaacttgggcagttac

SEQ ID NO: 235279 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggcgaacgctatttctgggaagccgcatctcgagcgaa

SEQ ID NO: 235280 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggattatacagcttcccgcctctgtccctatgcgtctg

SEQ ID NO: 235281 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggatccatgagccttcggcactatccagttgacgctca

SEQ ID NO: 235282 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggatccatgagccttcggcactatccagttgacgcaca

SEQ ID NO: 235283 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggaggcttttaagcacttctcggtaacttggcagttac

SEQ ID NO: 235284 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgctccggattttcctgcattacgttcatcccacgtgca

SEQ ID NO: 235285 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgcgaagcgctattttctgggaaccgcatctcgagcgaa

SEQ ID NO: 235286 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgcgaactgcctgtttggcgctatccaaattttaggcta

SEQ ID NO: 235287 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgcccaaccacggtgtcgttgtcactgactacagtgtct

SEQ ID NO: 235288 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgcatacattgcccctccacgcctcgtccccaatctgcg

SEQ ID NO: 235289 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgatgggctttaagcacttctcggtaacttggcagttac

SEQ ID NO: 235290 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgatgggcctttaagcacttctcgtaacttggcagttac

SEQ ID NO: 235291 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgatggctttaagcacttcatcgtaacttgggcagttac

SEQ ID NO: 235292 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgatccttcctcagcctccgcggtgcaggatttgcacgt

SEQ ID NO: 235293 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgataagcacgattcctcctgtcctccttgcgcgcattt

SEQ ID NO: 235294 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgagggcctttaagcacttctcgtaacttgggcagttac

SEQ ID NO: 235295 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgaggcttttaagcacttctcggtaacttgggcagttac

SEQ ID NO: 235296 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgaggccttaagcactttctcggataccttggtcagtac

SEQ ID NO: 235297 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgaggccttaagcactttctcggataccttggcagtaac

SEQ ID NO: 235298 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgactgcgggcatttgcctcgtgtttgtatcacgtgaga

SEQ ID NO: 235299 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgactgcaggcatttgcctcgtgtttgcatcacgtgaga

SEQ ID NO: 235300 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgacggccgaatcattccgcctcggctttctaaacgcat

SEQ ID NO: 235301 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgacctgtgaatcgtttacctctggactacctggggcaa

SEQ ID NO: 235302 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgaccgcctcatcatcggacacgactgtatcagttgctg

SEQ ID NO: 235303 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgaccgcctcatcatcggacacgacgtgtatcagtgctg

SEQ ID NO: 235304 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgaatactgcgtgagattgcgcctcggacctcccggccg

SEQ ID NO: 235305 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgaactgtgaatcgtttacctctgggctacctggggcaa

SEQ ID NO: 235306 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgaactgcgaatcgtttacctctggactacctggggcaa

SEQ ID NO: 235307 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcttatccggcaggacgtctttcgtgcactatcacgatt

SEQ ID NO: 235308 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atctgttcgcctctggatcctcctctcggatatggctgcg

SEQ ID NO: 235309 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atctgcctcgctgtaagcttacttttacgtaaaatgcctc

SEQ ID NO: 235310 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
atctcggggccccttttatgaaacttacatgaaagcgcac

SEQ ID NO: 235311 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atctccgtctagcacgtgcactatcacggctttagttaga

SEQ ID NO: 235312 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atctccgtctaacacgtgcgctatcacggctttagttaga

SEQ ID NO: 235313 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atctccgtctaacacgtgcactatcacggttttagttaga

SEQ ID NO: 235314 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atctccgtctaacacgtgcactatcacggctttagttgga

SEQ ID NO: 235315 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atctccgcctaacacgtgcactatcacggctttagttaga

SEQ ID NO: 235316 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atctactaccactagcgggctgtgatgtaaggccgtaata

SEQ ID NO: 235317 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgtgggctttagcacttctcggtaacttgggcagttac

SEQ ID NO: 235318 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgtcgggccctttacttgaaacttacatgaaagcgcac

SEQ ID NO: 235319 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgtcgggccccttttgtgaaacttacatgaaagcgcac

SEQ ID NO: 235320 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgtcgggccccttttatgaaacttacatgaaggcgcac

SEQ ID NO: 235321 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgtcgggccccttttatgaaaattacatgaaagcgcac

SEQ ID NO: 235322 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgtcgggcccctttcatgaaacttacatgaaagcgcac

SEQ ID NO: 235323 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgtcctgagcttgtggcacctatccagttgacgcttca

SEQ ID NO: 235324 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgtcctagcggattcgtctcgatcccccatgcgctgta

SEQ ID NO: 235325 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgtccatgagcttctgggcactatccagttgacgctca

SEQ ID NO: 235326 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgtccatgagcttcggcatctatccagttgacgctcta

SEQ ID NO: 235327 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgtacttaccaccctgacatcgcggggaactaatggtt

SEQ ID NO: 235328 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcggtccgtgagccttcggcactatccagttgacgctca

SEQ ID NO: 235329 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcggtccatgagccttcggcactatccagttgacgctcg

SEQ ID NO: 235330 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcggatgggcctttagacacttctcgtacttggtagtac

SEQ ID NO: 235331 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgatgggctttaagcacttctcgtacttgagcagttac

SEQ ID NO: 235332 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgatgggccttttagcacttctcgtacttggcagttac

SEQ ID NO: 235333 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgagccttaacgcacttctcggtaccgtggtcagtgac

SEQ ID NO: 235334 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgaatcgcctcgatctctgacataatatgatacgtctg

SEQ ID NO: 235335 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgaagggcacgtgcaaaatcgcctcgttcctaacacag

SEQ ID NO: 235336 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcctcacaatgcattgagaatatcttccattcttgaacg

SEQ ID NO: 235337 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgtggtacgcctcgattccgcccatacatgcgtgtaa

SEQ ID NO: 235338 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgtactcgtataattcaggatggcttattatctagct

SEQ ID NO: 235339 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgggacgcctcgatcctcgcataatatgatacgtctg

SEQ ID NO: 235340 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggagcgcctcgatcctcgcatagtatgatacgtctg

SEQ ID NO: 235341 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgccttgatcctcgcataatatgatacgtcag

SEQ ID NO: 235342 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgattctcgcataatatgatacgtctg

SEQ ID NO: 235343 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcttcgcataatatgatacgtctg

SEQ ID NO: 235344 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcattatatgatacgtctg

SEQ ID NO: 235345 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcatataatgatacgtctg

SEQ ID NO: 235346 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcatagtatgatacgtctg

SEQ ID NO: 235347 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcataatatggtacgactg

SEQ ID NO: 235348 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcataatatgattcgtctg

SEQ ID NO: 235349 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcataatatgatgcgtctg

SEQ ID NO: 235350 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcataatatgatacgtcgg

SEQ ID NO: 235351 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcataatatgatacgtccg

SEQ ID NO: 235352 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcataatatgatacggctg

SEQ ID NO: 235353 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcataatatgatacgcctg

SEQ ID NO: 235354 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcataatacgatacgtctg

SEQ ID NO: 235355 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcataacatgatacgtctg

SEQ ID NO: 235356 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcataaaatgatacgtctg

SEQ ID NO: 235357 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcacaatatgatacgtctg

SEQ ID NO: 235358 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcacataatatgatacgtctg

SEQ ID NO: 235359 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgccccgatcctcgcataatatgatacgtctg

SEQ ID NO: 235360 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgcgccgggttctcattctcccgactacgtgagatta

SEQ ID NO: 235361 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgccttagatccgtccccttttctcccttgcgcaagg

SEQ ID NO: 235362 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgcctcgcttgtgcacaacttgcatcccgcgtctgcg

SEQ ID NO: 235363 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgcctcgcttgtgcacaactcgtatcccgcgtctgcg

SEQ ID NO: 235364 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgcctcgcttgtgcacaactcgcttcccgcgtctgcg

SEQ ID NO: 235365 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgcctcgcttgtgcacaactcgcatcccacgtctgcg

SEQ ID NO: 235366 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgcctcatcatcggacacgacgtgtatcagttggctg

SEQ ID NO: 235367 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgcctcatatcatcactagtgggcctcccctcgtttg

SEQ ID NO: 235368 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgcctcaaaaagtcctcgttgtccttcaatcgtactg

SEQ ID NO: 235369 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgaacgcctcgatcctcgacataatatgatacgtctg

SEQ ID NO: 235370 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcccgtcctcatgatgcgcgcattgtggtactattaggg

SEQ ID NO: 235371 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcccgtcagtcccaaaacttggttaaccagtgtgcacac

SEQ ID NO: 235372 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgcctatacatgcatgtaa

SEQ ID NO: 235373 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgcccatacatgcgtgtaa

SEQ ID NO: 235374 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgcccatacatgcatttaa

SEQ ID NO: 235375 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgcccatacatgcatgtga

SEQ ID NO: 235376 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgcccatacatgcatgtat

SEQ ID NO: 235377 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgcccatacacgcatgtaa

SEQ ID NO: 235378 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgcccacgcatgcatgtaa

SEQ ID NO: 235379 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgccatcacatgcatgtaa

SEQ ID NO: 235380 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgccatacatgcatgtaac

SEQ ID NO: 235381 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccacccatacatgcatgtaa

SEQ ID NO: 235382 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgactccgcccatacatgcatgtaa

SEQ ID NO: 235383 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgactccgcccatacatgcacgtaa

SEQ ID NO: 235384 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgccccgattccgcccatacatgcatgtaa

SEQ ID NO: 235385 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggcgactcgtaagcaccgcacctccagtttcgcg

SEQ ID NO: 235386 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatgatacgcctcgattccgcccatacatgcatgtaa

SEQ ID NO: 235387 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatcctccagcgcattgtcatagccccgagtgcactg

SEQ ID NO: 235388 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccagaacgcctcgatcctcgcgtaatatgatacgtctg

SEQ ID NO: 235389 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcagtggaacttcctctctgataccgcctcgattgcatg

SEQ ID NO: 235390 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcagcagttaatctgccctctgatgaaaccggttacgtt

SEQ ID NO: 235391 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcagactgcccgtctacacgctgggctaccaccgtatag

SEQ ID NO: 235392 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atatggggctttaagcacttctcgtaacttgggcagttac

SEQ ID NO: 235393 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atatgggctcctaagcacttctcggtaacttggcagttac

SEQ ID NO: 235394 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atatgacgtcggttcgcctcgggtccatcccaattgtctg

SEQ ID NO: 235395 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atatctttatccgccccctctgcatggtgggcctacatcg

SEQ ID NO: 235396 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atatctttatcccgcccctctgcatggtgggcctacatcg

SEQ ID NO: 235397 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atatcctttatccgcccctctgcatggtgggcctacatcg

SEQ ID NO: 235398 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atatcctgatcgatcagataggcctgggttctaccctagt

SEQ ID NO: 235399 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atatagctggcgtatttgcctcgatcctctattgtctgcg

SEQ ID NO: 235400 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atatagctagcgtatttgcctcgatcctctgttgtctgtg

SEQ ID NO: 235401 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atatagccggcgtatttgcctcgatcctctattgtctgtg

SEQ ID NO: 235402 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atataacgcctgtctttaatctcgcagagtgctcatgagc

SEQ ID NO: 235403 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ataggtcctggggtatccgccttgctaagtttgtgcatgc

SEQ ID NO: 235404 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ataggtcctggggtatccgcctcgctaagtctgtgcatgc

SEQ ID NO: 235405 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ataggtcctggggtatccgcctcgctaagcttgtgcatgc

SEQ ID NO: 235406 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ataggtacctgtactagtaaaaattgctgctcccatgctg

SEQ ID NO: 235407 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atagcgtacggagccgtctttcagagaccactctggatga

SEQ ID NO: 235408 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atagacttttgacatccgcccctctgtcagtggccaccgg

SEQ ID NO: 235409 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atactgtagttggtcgttttcgcaggactacctggagtga

SEQ ID NO: 235410 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atactattccggccttcaccgtcctcaatacggacgaatg

SEQ ID NO: 235411 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atactagttacgcctcgattcgttccacgtgtcgggacca

SEQ ID NO: 235412 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atacgggtgcccacatctcgcctcacgatctcctagtctg

SEQ ID NO: 235413 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ataatggccatttttacgcctggggtctctcgcacgctag

SEQ ID NO: 235414 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ataagctgactctcgcctcgctgtctccagaatgtgcgca

SEQ ID NO: 235415 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ataacccgggcgccttgctcttccctgaaatagtctgctg

SEQ ID NO: 235416 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ataaatattcacgttgaaccgccttgctcctcttagtctg

SEQ ID NO: 235417 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ataaagtggcgcgtcacgtttaatcgcctcggttctgctg

SEQ ID NO: 235418 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agttttctcggatccaaacgcatatcctcctccgcctcct

SEQ ID NO: 235419 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agttttctcggatccaaacgcatatcctcccccgcctcgt

SEQ ID NO: 235420 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agttttctcggatccaaacgcatatccccctccgcctcgt

SEQ ID NO: 235421 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agttcgccagtcacatcaactatgatgacgcttgactgga

SEQ ID NO: 235422 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agttagatctaacgagtccgctttgatccgtccccggatg

SEQ ID NO: 235423 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agttactggtacgccttgatcttccacgtgcacgtaaatg

SEQ ID NO: 235424 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtgttaagcttacatacgcctgggtcactctttgttctg

SEQ ID NO: 235425 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtgtctcggatctgttttttactgcgttgcctcccgaga

SEQ ID NO: 235426 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtgtaaattacgttatttacccccacgcatcacgtacgt

SEQ ID NO: 235427 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtggcactacgcctggtttccttcccaaagaagttcgtt

SEQ ID NO: 235428 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtgccttgaccgccttgatcttcttctcggaacgcgtta

SEQ ID NO: 235429 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtgcctgactgccttgatccttcttctcggaaacgcgta

SEQ ID NO: 235430 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtgcctgaccgccttgatcctccttctcggaaacgcgta

SEQ ID NO: 235431 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtgcacacgcctgggtttcctttccccaaaagagtcttt

SEQ ID NO: 235432 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtctggccttgttatggactaccatatcagaaaggtact

SEQ ID NO: 235433 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtctgaccctgttatggactaccatgtcagaaaggtact

SEQ ID NO: 235434 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtctgaccctgttatggactaccacatcagaaaggtact

SEQ ID NO: 235435 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtctgaccctgctatggactaccatatcagaaaggtact

SEQ ID NO: 235436 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtccctgtgtcttgttgccacagacgttcagtgcccccg

SEQ ID NO: 235437 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtcccgggtccgcctcgatgagtttaggtaccataaaca

SEQ ID NO: 235438 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
agtcattaatccttgttggactaccaccaaaaccgattaa

SEQ ID NO: 235439 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtaggtcgcctggtccgcctcgatcctctataccgtcta

SEQ ID NO: 235440 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtactacgcctcgaggagctctcacctccctctgtctgg

SEQ ID NO: 235441 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aggttctcggatcgttgttttccgtatcgcatagtcccat

SEQ ID NO: 235442 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agggtccatgagcttctcggcactatccagttgacgctca

SEQ ID NO: 235443 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agggtaccatccgcctcgcaaaccgggatatccgcgtacg

SEQ ID NO: 235444 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aggcccgggttccgcctcagtccccaaaatgcgcgcattt

SEQ ID NO: 235445 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agcttgtggtaaccgcccctctgatgtgacgcgctaacac

SEQ ID NO: 235446 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agctgtcgacatctctacctctgctcctcccaagtgtctg

SEQ ID NO: 235447 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agctaacccacatcgagcggtttcagatgttaaaatacaa

SEQ ID NO: 235448 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agcggccgattcgccttgatcctactgagctcatgttctg

SEQ ID NO: 235449 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agcggccgattcgccttgatcctactgagctcacgttatg

SEQ ID NO: 235450 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agcgaaacgctattttctgggaagccgcatctcgagcgaa

SEQ ID NO: 235451 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agcctgaccctgttatggactaccatatcagaaaggtact

SEQ ID NO: 235452 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agcccgttgtgggttgatttgcgcgtactagtgccatcga

SEQ ID NO: 235453 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agccccaagtctaatctggacgctatttcagatgtataga

SEQ ID NO: 235454 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agccatccgtatcgagcgattccggctgagataataccta

SEQ ID NO: 235455 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agcatcgttccagtcttctcccacagcggctggcactatc

SEQ ID NO: 235456 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agcacgcggaaagtcacacgagctatcgtgacgctggctt

SEQ ID NO: 235457 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agattctagattaaccgcctcggtcagcccagattgtgcg

SEQ ID NO: 235458 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agatctccctatccgcttcgtttgagtactcactcggggc

SEQ ID NO: 235459 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agataggacctacgcccgcctcagtctgactcatcgtctg

SEQ ID NO: 235460 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agagctcccgcctcgtgtccggaacgttctggagactgcg

SEQ ID NO: 235461 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agactacttcgatggttcatcgtcgattccaaccctccta

SEQ ID NO: 235462 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agactactccgatggacaatcgtaatttaggagtcgccta

SEQ ID NO: 235463 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agactactccgagtgtctatcggcctttccttcgtcgggc

SEQ ID NO: 235464 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agaccggggtccgcctcaagctagctacctccattgtctg

SEQ ID NO: 235465 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agaccggggcctgcctcaagctagctacctccattgtctg

SEQ ID NO: 235466 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agaccggggcccgcctcgagctagctacctccattgtctg

SEQ ID NO: 235467 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agaagcacctcaacccgttactaaacccctgcttctccaa

SEQ ID NO: 235468 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agaacccgtcgagtcatctttcaaagactactttgaatac

SEQ ID NO: 235469 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agaaattcctccttcgtctgattgaactgcaaggtacccc

SEQ ID NO: 235470 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acttttgtagccgatccctgggctacccgggaagaacggt

SEQ ID NO: 235471 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actttgcaatgatccgccttgatcctccagttgcaaccta

SEQ ID NO: 235472 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actttctcggatcgtatgtcttcgcatcattcaccccagt

SEQ ID NO: 235473 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acttcatcatcgtctgtgtagttgactacaacttttagta

SEQ ID NO: 235474 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actgtaggcacctgctctatgtcgtggggagtaactggtt

SEQ ID NO: 235475 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actgatgcgatttaaccgggtgtgagttccatgcagtact

SEQ ID NO: 235476 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actctcagcccgagatgcgaagactacttcggttgctcat

SEQ ID NO: 235477 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actacttgcaaggactccgcctcgcattctcctgttatat

SEQ ID NO: 235478 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actactcccttgagctcgcgcgcgcgcgctttctcgtttg

SEQ ID NO: 235479 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actaccttcgtctagtggttcaatagcatgaaacttcgta

SEQ ID NO: 235480 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actaccttcgtctagcggcgctctgtggtaagattctact

SEQ ID NO: 235481 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actaccttcgtccagcggtgcgctggggactttacccctc

SEQ ID NO: 235482 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actaccttcgtccagcggtgcgccggggactttatccctc

SEQ ID NO: 235483 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actaccatcgtctagcgagcgaatgaaaaccgtcactgtt

SEQ ID NO: 235484 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actaccatcgtctagcgagcgaacgaaaatcgtcactgtt

SEQ ID NO: 235485 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actaaagtatgcattgaattggccgcctcgctccagcctg

SEQ ID NO: 235486 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgtcgacaccgcctctgtccatatgaccggtctcgtctg

SEQ ID NO: 235487 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgtcagcctcggttatcctacgcgtacctctcatgcgca

SEQ ID NO: 235488 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgtacgcttcacgcacgcggattgtacccgaactgggtt

SEQ ID NO: 235489 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgggctcacggatcttcacctgaaacgcctcccagttcg

SEQ ID NO: 235490 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acggccgcctcgaaactacccttctcgatcaacacctgta

SEQ ID NO: 235491 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgctattccggtaagtcatcgtttaaccgtttgttgcaa

SEQ ID NO: 235492 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgctattccggtaagtcatcgttcaaccgtttgttgcaa

SEQ ID NO: 235493 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgctattccggccttcaccgtcctcaatacggacgaatg

SEQ ID NO: 235494 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgcgtcgctaactcggatccttttgatatcactccccta

SEQ ID NO: 235495 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgcgtacgccttggttttcctgggtaccctcgccgtttg

SEQ ID NO: 235496 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgcctctgttccccactactgtacagtaacgactgcgcg

SEQ ID NO: 235497 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgcctcgaacactgacgtcgtggaaccttcgattgctag

SEQ ID NO: 235498 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgccgacgctacctttatggatgccacatactgacgaaa

SEQ ID NO: 235499 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgcatacgccttggttttcctgggtacccccgccgtttg

SEQ ID NO: 235500 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgcaccccgatagtcatcttcgctggaccacccgcgtta

SEQ ID NO: 235501 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgattcttcctcagcctccgcggtgcaggacttgcacgt

SEQ ID NO: 235502 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgattcttccccagcttccgcggtgcaggatttgcacgt

SEQ ID NO: 235503 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatcttgataacaaccgcctcgctcctctggttgtccg

SEQ ID NO: 235504 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttcctcagcttccgcggtgctggatttgcacgt

SEQ ID NO: 235505 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttcctcagcttccgcggtgcaggatttgcatgt

SEQ ID NO: 235506 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttcctcagcttccgcggtgcaggatttgcacga

SEQ ID NO: 235507 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttcctcagcttccgcggtgcaggattcgcacgt

SEQ ID NO: 235508 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttcctcagcttccgcggtgcaggattagcacgt

SEQ ID NO: 235509 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttcctcagcttccgcggtgcaggatctgcacgt

SEQ ID NO: 235510 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttcctcagcttccgcggtgcaggatatgcacgt

SEQ ID NO: 235511 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttcctcagcctccgcggtgcatgatttgcacgt

SEQ ID NO: 235512 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttcctcagcctccgcggtgcagtatttgcacgt

SEQ ID NO: 235513 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttcctcagcctccgcggtgcaggattcgcacgt

SEQ ID NO: 235514 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttcctcagcctccgcggtgcaggacttgcacgt

SEQ ID NO: 235515 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttcctcagcctccgcagtgcaggatttgcacgt

SEQ ID NO: 235516 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgactcttcctcggcttccgcggtgcaggatttgcacgt

SEQ ID NO: 235517 - skipped

SEQ ID NO: 235518 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgacctatccgcttaattacgtccatacctttgggtgta

SEQ ID NO: 235519 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgaccgggcccgctcaagctagcctacctccattgtctg

SEQ ID NO: 235520 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgacccttcctcagcttccgcggtgcaggatttgcacgt

SEQ ID NO: 235521 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acctctatagtcgtcggcgtagcacgctattgcttagaag

SEQ ID NO: 235522 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acctaggctgcctcgaccctccaaagcccggtccttttga

SEQ ID NO: 235523 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgtgcattgggtcggtttggtggggactaccccttgta

SEQ ID NO: 235524 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgtaggcacctgctctatatcgtggggagtaacaggtt

SEQ ID NO: 235525 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accggtagcctcgatcccgcgctatggtaccatggtttga

SEQ ID NO: 235526 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accggcctcagttctactgtattaccgcggatacagttta

SEQ ID NO: 235527 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accggcctcaggttccctaacgcgttacgcttccggaatg

SEQ ID NO: 235528 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accggcctcaggtccctaactgcgttcgccttccggaatg

SEQ ID NO: 235529 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accggccacccgatagtcatcttcactggaccaccgtgta

SEQ ID NO: 235530 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accggcaccccgatagtcatcttcactggacacccgtgta

SEQ ID NO: 235531 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgctttgtgtgcgacacatgtctacgactcctcttcag

SEQ ID NO: 235532 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcctcgcgtcgtgtacacgaagacctccggagatttg

SEQ ID NO: 235533 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcctcgaacactgactcgtggaaccttcgattgctag

SEQ ID NO: 235534 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcctcgaaatgcgcatacccctgggatccatgacatg

SEQ ID NO: 235535 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcctcagttcttagatcgatttaccccaagaatacag

SEQ ID NO: 235536 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcctcagtcttagatcgatttatccccaagaatacag

SEQ ID NO: 235537 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcctcaggttccctaatgcgttacgccttccggaatg

SEQ ID NO: 235538 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcctcaaacatcgctagcgtgaaacttctccggacgt

SEQ ID NO: 235539 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgccctgggatccttcccaacgtcttacagtatgcttg

SEQ ID NO: 235540 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcaccccgatagtcatcttcactggaccaccgtgtta

SEQ ID NO: 235541 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accctcggatcattgtgcatgcacttttcgcctcgcctac

SEQ ID NO: 235542 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accctattttgacgtctcttcggggactaccccgattctg

SEQ ID NO: 235543 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accctatcttgacgtctcttcggggactaccccggttctg

SEQ ID NO: 235544 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accctatcttgacgcctcttcggggactaccccgattctg

SEQ ID NO: 235545 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accctatcctgacgtctcttcggggactaccccgattctg

SEQ ID NO: 235546 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accctatcatgacgtctcttcggggactaccccgattctg

SEQ ID NO: 235547 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acccgcttgtgtgcgacacatgtctacgactcctcttcac

SEQ ID NO: 235548 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acccgcttgtgtgcgacacatgtctacgactcctcctcag

SEQ ID NO: 235549 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acccgcttgtgtgcgacacatgtctacgactccccttcag

SEQ ID NO: 235550 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acccagtagcaaatggaactgcctccgcatcagtaatgcg

SEQ ID NO: 235551 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accagcgtacgagcttcgccttggtcttgcccgtgagttg

SEQ ID NO: 235552 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accacacgtgtgatgcgcctccggtcctcgtttgtctata

SEQ ID NO: 235553 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accacacgtgtgatgcgcccccggtcctcgtttgtctgta

SEQ ID NO: 235554 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acattattccggtaagtcatcgtttaaccgtttgttgcaa

SEQ ID NO: 235555 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acattattccggccttcaccgtcctcaatacggacgaatg

SEQ ID NO: 235556 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acatgtcatgcctcggatgcattcacctcttatatggcca

SEQ ID NO: 235557 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acatcctcatgacggtctgttgatggctacatcattgttc

SEQ ID NO: 235558 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acataaccgcactgcggtcctgttccgcctttggtcatcc

SEQ ID NO: 235559 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagtgggttccatgctttaggcgcctcttgctttgggtc

SEQ ID NO: 235560 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagtgggttccatgctttaggcgcctcttattttgggtt

SEQ ID NO: 235561 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagtgggttccatgctttaggcgcctcttattctgggtc

SEQ ID NO: 235562 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagtgggttccatgctctaggcgcctcttattttgggtc

SEQ ID NO: 235563 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagtgggtcccatgctttaggcgcctcttattttgggtc

SEQ ID NO: 235564 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acaggagctcatttccgcctcatcttcccaggcaagcctg

SEQ ID NO: 235565 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagctattccggccttcaccgtcctcaatacggcgaatg

SEQ ID NO: 235566 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
acagcactggtcctcagcgcgcgacccatctccgtcagta

SEQ ID NO: 235567 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactggactctcaggcgcgcgacccatctctcagta

SEQ ID NO: 235568 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactggactctcagcgcgcgacccgtctcgtcagta

SEQ ID NO: 235569 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactggactctcagcgcgcgacccatctcgtcggta

SEQ ID NO: 235570 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactggactctcagcgcgcgacccatctcgtcaata

SEQ ID NO: 235571 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactggactctcagcgcgcgaacccatctctcagta

SEQ ID NO: 235572 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactggactctcagcgcgcaacccatctcgtcagta

SEQ ID NO: 235573 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactggactctcagacgcgcgacccatctctcagta

SEQ ID NO: 235574 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactggactctcaacgcgcgacccatctcgtcagta

SEQ ID NO: 235575 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactggactcctcagcgcgcacaccatctctcagta

SEQ ID NO: 235576 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactgttccggccttcaccgtcctcaatacggacgaatg

SEQ ID NO: 235577 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattctggtaagtcatcgtttaaccgtttgttgcaa

SEQ ID NO: 235578 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaggtcatcgtctaaccgtttgttgcaa

SEQ ID NO: 235579 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcgtcgtttaaccgtttgttacaa

SEQ ID NO: 235580 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcattgtttaaccgtttgttgcaa

SEQ ID NO: 235581 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaccgtttgttcgcaa

SEQ ID NO: 235582 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgtttgttgtaa

SEQ ID NO: 235583 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgttcgttgcaa

SEQ ID NO: 235584 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgtctgttgcaa

SEQ ID NO: 235585 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgcctgttgcaa

SEQ ID NO: 235586 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccctttgttgcaa

SEQ ID NO: 235587 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccatttgttgcaa

SEQ ID NO: 235588 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgttcaaccgcttgttgcaa

SEQ ID NO: 235589 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgttaaaccgtttgttgcaa

SEQ ID NO: 235590 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgcttaaccgtttgttgcaa

SEQ ID NO: 235591 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagctcttcgattaccgtttgttgcaa

SEQ ID NO: 235592 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggccttcaccgtcttcaatacggacgaatg

SEQ ID NO: 235593 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggccttcaccgtcctcagtacggacggatg

SEQ ID NO: 235594 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggccttcaccgtcctcaatacgggccaatg

SEQ ID NO: 235595 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggccttcaccgtcctcaatacggacggatg

SEQ ID NO: 235596 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggcctacaccgtcctcaatacggacgaatg

SEQ ID NO: 235597 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggcaagtcatcgtttaaccgtctgttgcaa

SEQ ID NO: 235598 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactatccgtttgtcgtcctcctgtggtattgcgcatgc

SEQ ID NO: 235599 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactatcccggtaagtcatcgtttaaccgtttgttgcaa

SEQ ID NO: 235600 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactatcccggccttcaccgtcctcgatacggacgagtg

SEQ ID NO: 235601 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactatcccggccttcaccgtcctcaatacggacgaatg

SEQ ID NO: 235602 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acacgtattccggtaagtctcgtttaaccgtttgttgcaa

SEQ ID NO: 235603 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acaccgacgctctgtatacgctggactacccgcgtttcaa

SEQ ID NO: 235604 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acacactggactctcagcgcgcgtacccatctcgtcagta

SEQ ID NO: 235605 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acaattcgaaattggagcctgggttcttcccacaacacat

SEQ ID NO: 235606 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acaacccgggaacgcctcgttacagctttatgcataaaga

SEQ ID NO: 235607 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aattttctcggatccaaacgcatatcctcctccgcctcgt

SEQ ID NO: 235608 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aattctgtttttaagttggcgaggtcctctaacttttggg

SEQ ID NO: 235609 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aattctcgggtgctatacgttatcgtcatcctatagcata

SEQ ID NO: 235610 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aattcgccagtcacatcaactatgatgacgcttgactgga

SEQ ID NO: 235611 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttgagcttacatacgcctgggtcactctttgttctg

SEQ ID NO: 235612 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttagcttacatacgccttgggtcactctttgttctg

SEQ ID NO: 235613 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttagcttacatacgcctgggtcactctttgttctga

SEQ ID NO: 235614 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttagctacatacgccttgggtcactctttcgttctg

SEQ ID NO: 235615 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacttacgcctgggtcactctttgttctg

SEQ ID NO: 235616 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacctacgcctgggtcactctttgttctg

SEQ ID NO: 235617 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacatcgacgcctggtcactctttgttcg

SEQ ID NO: 235618 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacatcacgcctgggtcactcttgttctg

SEQ ID NO: 235619 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacatatgcctgggtcactctttgttctg

SEQ ID NO: 235620 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacatacgtctgggtcactctttgttctg

SEQ ID NO: 235621 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacatacgcctgggtcattctttgttctg

SEQ ID NO: 235622 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacatacgcctgggtcactttttgttctg

SEQ ID NO: 235623 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacatacgcctgggtcactctttgttctt

SEQ ID NO: 235624 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacatacgcctgggtcactctttgttccg

SEQ ID NO: 235625 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacatacgcctgggtcactctttgtcctg

SEQ ID NO: 235626 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacatacgcctgggtcactcgttgttctg

SEQ ID NO: 235627 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacatacgcctgggccactctttgttctg

SEQ ID NO: 235628 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacatacgcctgcgtcactctttgttctg

SEQ ID NO: 235629 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagctcacatacgcctgggtcactctttgttctg

SEQ ID NO: 235630 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgtactgtcgccttgcatgcaacccgatgcgtactctg

SEQ ID NO: 235631 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatggttcgttcgcctcggtacgcctcgatccgaccatgg

SEQ ID NO: 235632 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatggttcgttcgccctggtacgcctcgatcagaccatgg

SEQ ID NO: 235633 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatggtccatgagcttctggcactacccagttggcgctca

SEQ ID NO: 235634 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgggtctttaagcacttctcggtaacttgggcagttac

SEQ ID NO: 235635 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatggggcttttaagcacttctcggtaacttggcagttac

SEQ ID NO: 235636 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatggggcttttaagcacttctcggtaactgggcagttac

SEQ ID NO: 235637 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatggggctttaagcacttctcggtaacttgggcggttac

SEQ ID NO: 235638 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatggggcttcaagcacttctcggtaacttgggcagttac

SEQ ID NO: 235639 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgggctttaagctacttctcggtaacttgggcagttac

SEQ ID NO: 235640 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgctaagcttacatacgcctgggtcactcttcgttctg

SEQ ID NO: 235641 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatctcgaggtcactaggcactatcctagcactgtatcaa

SEQ ID NO: 235642 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatctcgagatcactaggcattatcctagcactgtatcaa

SEQ ID NO: 235643 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatctcgagatcactaggcactatcctggcactgtatcaa

SEQ ID NO: 235644 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatctcgagatcactaggcactatcctagcgctgtatcaa

SEQ ID NO: 235645 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatctcgagatcactaggcactatcctagcactgtatcga

SEQ ID NO: 235646 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcgtcgagatcactagcactatcctagcactgtatcaa

SEQ ID NO: 235647 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcggggctttaagcacttctcgataacttggcagttac

SEQ ID NO: 235648 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcgggaccgcctccaagctagctgctccattgtcctga

SEQ ID NO: 235649 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcgggaccgcctcaagctagctacctccattgtcctga

SEQ ID NO: 235650 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcgggaccgcctcaagctagctacctccattggcctaa

SEQ ID NO: 235651 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcggccgctcgtacgcctcggtccatcccaattgtctg

SEQ ID NO: 235652 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcgagccccaaattgtgcgctatcacatatactttggg

SEQ ID NO: 235653 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatccttagcgctaattaccacttaattcgcatcgagacc

SEQ ID NO: 235654 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcctcctcgcgattctcacccagtggtatagatagtgt

SEQ ID NO: 235655 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatccgggccgcctcaagctagctaccatccagttgtccg

SEQ ID NO: 235656 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatccgggcccgcctcaagtctactacttccattgtcgtg

SEQ ID NO: 235657 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatccgggaccgcctcaagctagctacctccattggcctg

SEQ ID NO: 235658 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatccatggtacgcctcgattccgccatatatgcatgtaa

SEQ ID NO: 235659 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcaggctttaagcacttctcggtaacttgggcagttac

SEQ ID NO: 235660 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcagcagtaattctgccctctgatgaaaccggttactt

SEQ ID NO: 235661 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcactgtaattctgcccctctgatgaaaccggttactt

SEQ ID NO: 235662 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacggtaattctgccctctgattgaaaccggttactt

SEQ ID NO: 235663 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagttattctgcccctctgatgaaaccggttactt

SEQ ID NO: 235664 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtgattctgcccctctgatggaaccggttactt

SEQ ID NO: 235665 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtagttctgcccctctgatgaaaccggttactt

SEQ ID NO: 235666 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattctgccctctgatgaaaccgggttactt

SEQ ID NO: 235667 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattctgcccctctgatgagaccggttactt

SEQ ID NO: 235668 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattctgcccctctgatgaagccggttactt

SEQ ID NO: 235669 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattctgcccctctgatgaaactggttactt

SEQ ID NO: 235670 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattctgcccctctgatgaaaccgtattact

SEQ ID NO: 235671 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattctgcccctctgatgaaaccggttattt

SEQ ID NO: 235672 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattctgcccctctgatgaaaccggctactg

SEQ ID NO: 235673 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattctgcccctctgatgaaaccggatactt

SEQ ID NO: 235674 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattctgcccctctgaggaaaccggttactt

SEQ ID NO: 235675 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattctgcccctctgaatgaaccggttactt

SEQ ID NO: 235676 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattctgccccctcatgaataccggttactt

SEQ ID NO: 235677 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattctgccccactgatgaaaccggttactt

SEQ ID NO: 235678 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattctccccctctgatgaaaccggttactt

SEQ ID NO: 235679 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattccgcccctctgatgaaaccggtcactt

SEQ ID NO: 235680 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattcagccccgctgatgaaaccggttactt

SEQ ID NO: 235681 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatactggcctcggtacgtgcttctccatcgctcttctcg

SEQ ID NO: 235682 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatactggcctcggtacattcttctccatcgctcttctcg

SEQ ID NO: 235683 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatactggccacggtacgttcttctccatcgctcttctcg

SEQ ID NO: 235684 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatacgccgcctctgatacggtcgtgatcgtagttcctcg

SEQ ID NO: 235685 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aataagcggtggtttctagagccatatcctctagggttat

SEQ ID NO: 235686 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aataagcctgtcttttaatctcggcagagtgctcatgagc

SEQ ID NO: 235687 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aataacagtaattctgcccctctgatgaaaccggttactt

SEQ ID NO: 235688 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagttaccgcggtactgaccgcctcgtctccgttctgctg

SEQ ID NO: 235689 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagtcgatccgtactttcaggcgctatcctgatcacccga

SEQ ID NO: 235690 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagtagtggccgaatttccgcctcggtctatttgtctgat

SEQ ID NO: 235691 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaggtgccacacgcctgggtttccttcccaaagagtcgtt

SEQ ID NO: 235692 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaggcagctgcctgcgcttggctaccaaccgctagaatgg

SEQ ID NO: 235693 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaggatacagcgtgattcttttacggactaccgttaagta

SEQ ID NO: 235694 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
aaggacctccgatccgcctcgtacctcaaaaccttgtctg

SEQ ID NO: 235695 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagcttacgcctaggaacctccaaacgcttatgcataaga

SEQ ID NO: 235696 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagcgtttgtattgtgtcgcacgctattgcgaggtaacat

SEQ ID NO: 235697 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagccggggcccgcctcgagctagctacctccattgtctg

SEQ ID NO: 235698 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagccggggcccgcctcaagctagctacctccactgtctg

SEQ ID NO: 235699 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagccggggcccgcctcaagctagcaacctccattgtctg

SEQ ID NO: 235700 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagccggggcccgcctcaagccagctacctccattgtctg

SEQ ID NO: 235701 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagccgggaccgcctcaagctagtctacctccattgtctg

SEQ ID NO: 235702 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagccgggacccgcctcaagctagctacctccattgtctg

SEQ ID NO: 235703 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagcccgggcccgcctcaagctagctacctccattgtctg

SEQ ID NO: 235704 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagatctcggatctggcgtaccacttggacaggttccttc

SEQ ID NO: 235705 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagaatgacaacaagactgaaaacgcgtcgataacttctg

SEQ ID NO: 235706 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aactgttccaccaatttggtaccaacaatcatgttctctg

SEQ ID NO: 235707 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aactattcgtatcgagcgagcgatacggcgtatccttgac

SEQ ID NO: 235708 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aactattcgcatcgagcggtcgtttttcgggaatacgggc

SEQ ID NO: 235709 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aactatccgtttgtccgtcctctcgtggtattgcgcatgc

SEQ ID NO: 235710 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aactaggttcgcctcgcgcctcctcgtgcacgtttgtctg

SEQ ID NO: 235711 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aactaagcccccggtccgcctcgctccttagtttgctgta

SEQ ID NO: 235712 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacgttaagcttacatacgcctgggtcactctttgttctg

SEQ ID NO: 235713 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacgtcctctgcgatcatctttcaaggattactttgatta

SEQ ID NO: 235714 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacgtattcgcatcgagcggtcgttttcgggaatacgggc

SEQ ID NO: 235715 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacgtattccatccgcctgggctcctcccagctacgactg

SEQ ID NO: 235716 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacgtactccgtccgcctgggctcctcccagctacgactg

SEQ ID NO: 235717 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacgtactccatccgcctgggctcctcccagctacgacta

SEQ ID NO: 235718 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacgggccccgctcaagctagctaccctcccattgtcctg

SEQ ID NO: 235719 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacggatccttcctacagcttccgcgtgcagtattgcacg

SEQ ID NO: 235720 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacctcggccttttcgtttgctcatgctcgatcctccttg

SEQ ID NO: 235721 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacctccaccgcctcgtaagcccgggcacttacctctgta

SEQ ID NO: 235722 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgtaccccagtttagtccttcctaaagggccctttaa

SEQ ID NO: 235723 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgtaccccagtttagtccttcctaaagggcccttcga

SEQ ID NO: 235724 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccggggcccgcttcaagctagctacctccattggtctg

SEQ ID NO: 235725 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccggggcccgccttcaagctagctacctccattgtctg

SEQ ID NO: 235726 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccggggcccgcctcaagctagctaccttccattgtctg

SEQ ID NO: 235727 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccggggcccgcctcaagcctactacctccattgtcctg

SEQ ID NO: 235728 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccggggcccccgctcaagctagctacctccattgtctg

SEQ ID NO: 235729 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggccgtctcgcaagctagtctacctccattgtctg

SEQ ID NO: 235730 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgctcaagtcctagctacctccacttgtctg

SEQ ID NO: 235731 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgctcaaggtcctactaccgtcacttgactg

SEQ ID NO: 235732 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgctcaaggcctagctaccttccacttgctg

SEQ ID NO: 235733 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgctcaagcctagctacctccacttgtactg

SEQ ID NO: 235734 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgctcaacgtctagctcacctccattgtgtg

SEQ ID NO: 235735 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaagtctagcctacctccattgtctg

SEQ ID NO: 235736 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaagctagctaccttccattgtctgc

SEQ ID NO: 235737 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaagctagctacctccatttggtctg

SEQ ID NO: 235738 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaagctagctacctccattggtctgc

SEQ ID NO: 235739 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaagcctagctgcctccattcgtctg

SEQ ID NO: 235740 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaagcctagctaccttccattgtctg

SEQ ID NO: 235741 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaacgtctagctacctccattgtctg

SEQ ID NO: 235742 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaacgctagctcacctccattgtctg

SEQ ID NO: 235743 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaacgctagctaacctccattgtctg

SEQ ID NO: 235744 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgccctcaagctagctacctccattgtctgc

SEQ ID NO: 235745 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggccccgcctcaagctagctacctccattgtactg

SEQ ID NO: 235746 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggacccgcctcaagctagctacctccattgtcctg

SEQ ID NO: 235747 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggacccgcctcaagcctagctacctccattgtctg

SEQ ID NO: 235748 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccggcactggacgcgtccttggtggactaccaccttat

SEQ ID NO: 235749 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccggagccgcctcaagctagctacctccattgtcctga

SEQ ID NO: 235750 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacagtgatgactctcggaacgcgtctttctcccacgcat

SEQ ID NO: 235751 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacagtgataactctcggaacgcgtctttctcccatgcat

SEQ ID NO: 235752 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacagtgataactctcggaacgcgtctttctcccacgcat

SEQ ID NO: 235753 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaattcaaggatcctcgtattgtccgccttgattctccaa

SEQ ID NO: 235754 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaatggtacgcttacatacgcctggtcactctttgttctg

SEQ ID NO: 235755 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaatcggggcccgcctcaagctggctacctccattgtctg

SEQ ID NO: 235756 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaatcgggccgcctcaagctagctacctccattgtcctga

SEQ ID NO: 235757 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaatcgggcccgcctcaagctagctacctccattgcctga

SEQ ID NO: 235758 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaatccgggccgcctcaagctagctacctccattgtcccg

SEQ ID NO: 235759 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaatccgggccgcctcaagctagctacctccattggcctg

SEQ ID NO: 235760 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaatccgggccgcctcaagctagctacctccattgcctga

SEQ ID NO: 235761 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaatccgggcccgcctcaagctagctacctccattgtctg

SEQ ID NO: 235762 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaatccgggcccgcctcaagctagctacctccatcgcctg

SEQ ID NO: 235763 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaataggacctacgcccgctccagtctgactcatcgtctg

SEQ ID NO: 235764 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaagcgtttgtatgtgtcgcacgctattgcgaggtaacat

SEQ ID NO: 235765 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaactggggcccgccttaagctagctacctccattgtctg

SEQ ID NO: 235766 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaactggggcccgcctcaagctagctacctcgattgtctg

SEQ ID NO: 235767 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacgtgggcccgcctcaagctagctacctccattgtctg

SEQ ID NO: 235768 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacgggggcccgcctcaagctagctacctccattgtctg

SEQ ID NO: 235769 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacggggcccgctcaagctagctgacctccattagtctg

SEQ ID NO: 235770 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacgggcccggcctcaagctagctacctccattcgtctg

SEQ ID NO: 235771 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacgggcccgcctcaacgcctagctacctccattgtctg

SEQ ID NO: 235772 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacgagatctcatgacgcctcgggtccttccttcgacta

SEQ ID NO: 235773 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacgagatctcatgacgcctcgggtccttccctcgactg

SEQ ID NO: 235774 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacgagatctcataacgcctcgggtccttccttcgactg

SEQ ID NO: 235775 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggtgcccgcctcaagctagctacctccattggctg

SEQ ID NO: 235776 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggtccgcctcaagctagctaccttccattgtctg

SEQ ID NO: 235777 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggtccgcctcaggctagctacctccattgtctg

SEQ ID NO: 235778 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggtccgcctcaagctagctgcctccattgtctg

SEQ ID NO: 235779 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggtccgcctcaagctagctacctccattgtcta

SEQ ID NO: 235780 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggtccgcctcaagctagctacctcaattgtctg

SEQ ID NO: 235781 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggggcccgcctcaagctgctacctccattgtctg

SEQ ID NO: 235782 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggggcccgcctcaagctagctactccattgtctg

SEQ ID NO: 235783 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggggcccgcctcaagctagctacctccattgctg

SEQ ID NO: 235784 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggggcccgcctcaagctagctacctcattgtctg

SEQ ID NO: 235785 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcgcgcctcaagctagctacctccattgtctg

SEQ ID NO: 235786 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcctgcctcaagctagctacctccattgactg

SEQ ID NO: 235787 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccgccttcgagctagctacctccattgtctg

SEQ ID NO: 235788 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccgcctcaagctagctacctccattgtctga

SEQ ID NO: 235789 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccgcctcaagctagctacctccattgtcctg

SEQ ID NO: 235790 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccgcctcaagctagctacctccattggtctg

SEQ ID NO: 235791 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccgcctcaagctagctacctccattcgtctg

SEQ ID NO: 235792 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccgcctcaagctagctacctaccattgtctg

SEQ ID NO: 235793 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccgcctcaagctagctaacctccattgtctg

SEQ ID NO: 235794 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccgcctcaagcctagctacctccattgtctg

SEQ ID NO: 235795 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccgcctacaagctagctacctccattgtctg

SEQ ID NO: 235796 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccgccctcaagctagctacctccattgtctg

SEQ ID NO: 235797 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgctcaagctagctacctccattggtctg

SEQ ID NO: 235798 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgctcaagctagctacctccaattgtctg

SEQ ID NO: 235799 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgctcaagctagcctacctccattgtctg

SEQ ID NO: 235800 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgctcaagcctagctgcctccattgtctg

SEQ ID NO: 235801 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgccttcaagctagctacctcccttgctg

SEQ ID NO: 235802 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgccttaagctagctacctcgattgtctg

SEQ ID NO: 235803 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctgaagctagctacctccattgtctg

SEQ ID NO: 235804 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcgagctagctacctctattgtctg

SEQ ID NO: 235805 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcgagctagctacctacattgtctg

SEQ ID NO: 235806 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcgagctagccacctccattgtctg

SEQ ID NO: 235807 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcgagccagctacctccattgtctg

SEQ ID NO: 235808 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctccagctagctacctccattgtctg

SEQ ID NO: 235809 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcagtctagctacctccattgtctg

SEQ ID NO: 235810 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagttagctacctccactgtctg

SEQ ID NO: 235811 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagcttgctacctctattgtctg

SEQ ID NO: 235812 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctggccacctccattgtctg

SEQ ID NO: 235813 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctggcaacctccattgtctg

SEQ ID NO: 235814 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctgctaccctccattgtctg

SEQ ID NO: 235815 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctatctacctccattgtctg

SEQ ID NO: 235816 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagcttcctccattgtctg

SEQ ID NO: 235817 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctgactccattgtctg

SEQ ID NO: 235818 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctccctccattgtctg

SEQ ID NO: 235819 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctatctccattatctg

SEQ ID NO: 235820 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacttccattatctg

SEQ ID NO: 235821 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacttccactgtctg

SEQ ID NO: 235822 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
aaaccggggcccgcctcaagctagctactcccattgtctg

SEQ ID NO: 235823 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctcctttgtctc

SEQ ID NO: 235824 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctcctttgcctg

SEQ ID NO: 235825 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccttagtctg

SEQ ID NO: 235826 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctcctatgtctg

SEQ ID NO: 235827 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccgttgtccg

SEQ ID NO: 235828 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccgtcgtctg

SEQ ID NO: 235829 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccatgtctga

SEQ ID NO: 235830 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctacattgtctg

SEQ ID NO: 235831 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctaccctcattgtctg

SEQ ID NO: 235832 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacccctattgtctg

SEQ ID NO: 235833 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctaccaccattgtcta

SEQ ID NO: 235834 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctaccaccatcgtctg

SEQ ID NO: 235835 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacatccattgtccg

SEQ ID NO: 235836 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagcctactccattgtctg

SEQ ID NO: 235837 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagccacctctattgtctg

SEQ ID NO: 235838 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagcatctctacttgtctg

SEQ ID NO: 235839 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagcatctccattgtcctg

SEQ ID NO: 235840 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagcagacctccttgtctg

SEQ ID NO: 235841 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagcaacctcctttgtctg

SEQ ID NO: 235842 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctacctacctccattgtctg

SEQ ID NO: 235843 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagcctagctacctccatgtctg

SEQ ID NO: 235844 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagcctagctacctcattgtctg

SEQ ID NO: 235845 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagccagctacctccattgtttg

SEQ ID NO: 235846 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagcagcttaccgtccattgtca

SEQ ID NO: 235847 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagatagctacctccattgtctg

SEQ ID NO: 235848 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaacgtctctacctccattgtctg

SEQ ID NO: 235849 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaacgctagctacctccattgctg

SEQ ID NO: 235850 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaacctagctacctccattgtctg

SEQ ID NO: 235851 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctaaagctagctacctccattgtctg

SEQ ID NO: 235852 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgccctacagcagctacctccattgtctg

SEQ ID NO: 235853 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgccccaagctagcaacctccattgtctg

SEQ ID NO: 235854 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcccagactcagctacctccattgtctg

SEQ ID NO: 235855 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcccaagctcagctacctccattgtctg

SEQ ID NO: 235856 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcccaagctagctacctccattgtctga

SEQ ID NO: 235857 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgactcaagctagctacctccattgtctg

SEQ ID NO: 235858 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccccgctcaagctagctacctccattgtctg

SEQ ID NO: 235859 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccacatcaagctagctacctccattgtctg

SEQ ID NO: 235860 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggaccgcctcaagctagctacttccattgtctg

SEQ ID NO: 235861 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggaccgcctcaagctagctacctccactgtctg

SEQ ID NO: 235862 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcgcgcctcaagctagcctacctccattgtctg

SEQ ID NO: 235863 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggccgcctcaagctagctacctcccattgtcgtg

SEQ ID NO: 235864 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgctcaagctagctacctccattgtcctga

SEQ ID NO: 235865 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgctcaacgctagctacctcccattgtctg

SEQ ID NO: 235866 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgctcaacgctagctaccgtccattgtctg

SEQ ID NO: 235867 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgccttcaagctagctaccttccattgctg

SEQ ID NO: 235868 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagttagcctacctccattgtctg

SEQ ID NO: 235869 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctgagctacctccattgtctg

SEQ ID NO: 235870 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctagctaccttctattgtctg

SEQ ID NO: 235871 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctagctaccttccattgctgc

SEQ ID NO: 235872 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctagctaccttccattgactg

SEQ ID NO: 235873 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctagctacctccattgtcgtg

SEQ ID NO: 235874 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctagctacctccattgtactg

SEQ ID NO: 235875 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctagctacctccattgccctg

SEQ ID NO: 235876 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctagctacctccaattgtctg

SEQ ID NO: 235877 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgccctaagctagctacctccattggtctg

SEQ ID NO: 235878 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggccccgctcaagctagctacctcccattgtctg

SEQ ID NO: 235879 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggccccgcctcgaagctagctacctccattgctg

SEQ ID NO: 235880 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggccccgcctcaagctagctacctccattgtctg

SEQ ID NO: 235881 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccccgctcaagctagctacctccattgtctg

SEQ ID NO: 235882 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggatccgcctcaagctagctacctccattgtctg

SEQ ID NO: 235883 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggaccgccttcaagctagctacctccattgtctg

SEQ ID NO: 235884 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggaccgcctcaagctagctacctaccattgtctg

SEQ ID NO: 235885 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcctcgagctagctacctccattgtctg

SEQ ID NO: 235886 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcctccagctagctacctccattgtctg

SEQ ID NO: 235887 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcctcaagcttgctacctccattgtctg

SEQ ID NO: 235888 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcctcaagctggctacctccattgtctg

SEQ ID NO: 235889 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcctcaagctagctacctctattgtctg

SEQ ID NO: 235890 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcctcaagctagctacctccgttgtctg

SEQ ID NO: 235891 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcctcaagctagctacctccattgcctg

SEQ ID NO: 235892 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcctcaagctagctacctccactgtctg

SEQ ID NO: 235893 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcctcaagctagcaacctccattgtctg

SEQ ID NO: 235894 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggagcctgcctcaagctagctacctccattgtctg

SEQ ID NO: 235895 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggagcccgcctcaagctagctacctccatcgtctg

SEQ ID NO: 235896 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacccgggcccgcctcaagctagctatctccattgtctg

SEQ ID NO: 235897 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccagggtccgcctcaagctagctacctccattgtctg

SEQ ID NO: 235898 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccagggcccgcctcaagctagctacctccattatctg

SEQ ID NO: 235899 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccagggcccgcctcaagctagctaccaccattgtctg

SEQ ID NO: 235900 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccagggcccgcctcaagctagccacctccattgtctg

SEQ ID NO: 235901 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccaaggcccgcctcaagctagctacctccattgtctg

SEQ ID NO: 235902 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaacgaaggtcgcggtccgcctcgatccgccccggatta

SEQ ID NO: 235903 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaaccggggcccgcctcaagctgctacctccattgtctg

SEQ ID NO: 235904 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaaccggggcccgcctcaagctagctacctccatgtctg

SEQ ID NO: 235905 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagcggcttttaagcacttctcggtaacttgggcagttac

SEQ ID NO: 235906 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattaataaatgcgc

SEQ ID NO: 235907 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtagtattgcgcatgc

SEQ ID NO: 235908 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaacttgggagttac

SEQ ID NO: 235909 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattaatagacgcgc

SEQ ID NO: 235910 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagatcaataaacgcgc

SEQ ID NO: 235911 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtctcttctcctgactacatgagattaataaacgcgc

SEQ ID NO: 235912 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagctatccgttgtccgtcctcttgtggtattgcgcatgc

SEQ ID NO: 235913 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcttctcgtggtattgcgcatgc

SEQ ID NO: 235914 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgtaggcacctgctctatgtcgtggggagtaacaggtt

SEQ ID NO: 235915 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcggttttaagcacttctcggtaacttggcagttac

SEQ ID NO: 235916 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcattc

SEQ ID NO: 235917 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctctcgtggtattgcgcatgtc

SEQ ID NO: 235918 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactacccgtttgtccgtcctctcgtggtattgcgcatgc

SEQ ID NO: 235919 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttgggcttttaagcacttctcggtaacttgggcagttac

SEQ ID NO: 235920 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgccagtctacatcaactatgatgacgcttgactgga

SEQ ID NO: 235921 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacatcgcggggagctaatggtt

SEQ ID NO: 235922 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttcttctccttgactacatgagattaataaacgcgc

SEQ ID NO: 235923 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctattgtggtattgcgcatgc

SEQ ID NO: 235924 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgccctctcgtggtattgcgcatgc

SEQ ID NO: 235925 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtattgcgtcatgc

SEQ ID NO: 235926 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtaattgcgcatgc

SEQ ID NO: 235927 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgtttgttgcga

SEQ ID NO: 235928 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgggctttcttcatggactaccatgttacaaaaggtcata

SEQ ID NO: 235929 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgattaacataga

SEQ ID NO: 235930 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttggcagttacc

SEQ ID NO: 235931 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacttgggcagttgc

SEQ ID NO: 235932 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaactcgggcagttac

SEQ ID NO: 235933 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagtcgacttctcggtaacttggtcagtac

SEQ ID NO: 235934 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttaattccagcgacttcggtggtgtcctctccattacca

SEQ ID NO: 235935 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtaagcctcgattccgcccatacatgcatgtaa

SEQ ID NO: 235936 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catgggcttttaagcacttctcggtaacttgggcagttac

SEQ ID NO: 235937 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacttatccgttgtccgtcctctcgtggtattgcgcatgc

SEQ ID NO: 235938 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgttctctcgtggtattgcgcatgc

SEQ ID NO: 235939 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcctgc

SEQ ID NO: 235940 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtagtgcgcatgc

SEQ ID NO: 235941 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttggggtattgcgcatgc

SEQ ID NO: 235942 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggcattgcgcatgc

SEQ ID NO: 235943 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtccttcttgtgtattgcgcatgtc

SEQ ID NO: 235944 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttatggtattgcgcatgc

SEQ ID NO: 235945 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcctgtccgtcctcttgtggtattgcgcatgc

SEQ ID NO: 235946 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacaatccgtttgtccgtcctcttgtggtattgcgcatgc

SEQ ID NO: 235947 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgctcaacgtctagctacctccattgtcgtg

SEQ ID NO: 235948 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaggtccgcggtttcactagactactactgatcacgtcg

SEQ ID NO: 235949 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccacctggtcgcgatacagaatacgattaacataaa

SEQ ID NO: 235950 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
tattcgccagtcacatcaactatgatggcgcttgactgga

SEQ ID NO: 235951 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttccgtgaacttgggcagttac

SEQ ID NO: 235952 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttcccgtgacttgggcagttac

SEQ ID NO: 235953 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaatcacttctcggtaacttgggcagttac

SEQ ID NO: 235954 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttcttggtaacttgggcagttac

SEQ ID NO: 235955 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttggggcagttac

SEQ ID NO: 235956 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagagtgctcatgagt

SEQ ID NO: 235957 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagcggttttaagctacttctcggtaacttgggcagttac

SEQ ID NO: 235958 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacgtcgcggggaactaatggtt

SEQ ID NO: 235959 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgaacccgaactgggtt

SEQ ID NO: 235960 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggcttcttctcctgactacatgagattaataaacgcgc

SEQ ID NO: 235961 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctcttgtggtattgcgcacgc

SEQ ID NO: 235962 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccttcctcttgtggtattgcgcatgc

SEQ ID NO: 235963 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgctcatgc

SEQ ID NO: 235964 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttcgtggtatgcgcatgc

SEQ ID NO: 235965 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgacctcttgtggtattgcgcatgc

SEQ ID NO: 235966 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtcagtcctcttgtggtattgcgcatgc

SEQ ID NO: 235967 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtattgcgcatagc

SEQ ID NO: 235968 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctctcgtcggtattgcgcatgc

SEQ ID NO: 235969 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatgtccgtcctcttgtggtattgcgcatgc

SEQ ID NO: 235970 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgcttgtccgtcctcttgtggtattgcgcatgc

SEQ ID NO: 235971 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcaccccgatagtcatcttcactggacacccgtgtta

SEQ ID NO: 235972 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgtaacgctatttctgggaagccgcatcgtcgagcgaa

SEQ ID NO: 235973 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgtctatttctgggaagccgcatctcgagcgaa

SEQ ID NO: 235974 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggctttgagcacttctcggtaacttgggcagttac

SEQ ID NO: 235975 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggctttaagcacttctcggtaacttggccagttac

SEQ ID NO: 235976 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggcctttaagcacttctcggtaacttggcagttac

SEQ ID NO: 235977 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgattaacgtaaa

SEQ ID NO: 235978 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccacgctcgtaa

SEQ ID NO: 235979 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacaactcacttcgtctttgatcgaccacgctcataa

SEQ ID NO: 235980 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattgggctttaagcacttctcggtaacttgggcagttac

SEQ ID NO: 235981 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattgcgctagtcacatcaactatgatgacgcttgactga

SEQ ID NO: 235982 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcctggctgga

SEQ ID NO: 235983 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgacgctcgactgga

SEQ ID NO: 235984 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagctactcgtgatacttgggcagttac

SEQ ID NO: 235985 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctggtgacttgggcagttac

SEQ ID NO: 235986 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttacagcacttctcggtaactgggcagttac

SEQ ID NO: 235987 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagtacttctcggtaacttgggcagttac

SEQ ID NO: 235988 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcctttaagcacttctcggtaacttggcagttac

SEQ ID NO: 235989 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacttgggctgttac

SEQ ID NO: 235990 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcactcctcggtaacttgggcagttac

SEQ ID NO: 235991 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacctctcggtaacttgggcagttac

SEQ ID NO: 235992 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcgtaacttgggcgagttac

SEQ ID NO: 235993 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcggtaacttgagcagttac

SEQ ID NO: 235994 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttcccggtaacttgggcagttac

SEQ ID NO: 235995 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taggggctttaagctacttctcggtaacttgggcagttac

SEQ ID NO: 235996 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacatcgcgggggactaatggtt

SEQ ID NO: 235997 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacatcacggggaactaatggtt

SEQ ID NO: 235998 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatggggctttaagcacttctcggtaacttggcagttac

SEQ ID NO: 235999 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtagtacttaccaccctgacatcgcggggaactaatggtt

SEQ ID NO: 236000 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcgaattgtacccgaactgggtt

SEQ ID NO: 236001 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggcttcacgcacgcggatttgtacccgaactgggtt

SEQ ID NO: 236002 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctacggcttcacgcacgcggattgtacccgaactgggtt

SEQ ID NO: 236003 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcccgactacatgagattaataaacgcgc

SEQ ID NO: 236004 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggctttggtgggggactacccccttgta

SEQ ID NO: 236005 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgagcattgggtcggtttggtggggactaccccttgta

SEQ ID NO: 236006 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttccacggcatccatgcgataggtactggactaccacta

SEQ ID NO: 236007 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactattacgatt

SEQ ID NO: 236008 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctcctgtggtattgcgcatgc

SEQ ID NO: 236009 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtgtctggttgaacaacga

SEQ ID NO: 236010 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccggcaccccgatagtcatcttcactggacacccgtgtta

SEQ ID NO: 236011 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttcaggttccctaactgcgttagccttccggaatg

SEQ ID NO: 236012 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcatcccgatagtcatcttcgctggaccacccgcgtta

SEQ ID NO: 236013 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccctgatagtcatcttcgctggaccaccgcgtta

SEQ ID NO: 236014 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatggtcatcttcactggaccacccgtgtta

SEQ ID NO: 236015 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatcagtcatcttcactggacacccgtgtta

SEQ ID NO: 236016 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtctcttcagctggaccacccgtgtta

SEQ ID NO: 236017 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtgctgcttatggagccgggtaccttccagcaagg

SEQ ID NO: 236018 - skipped

SEQ ID NO: 236019 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtgttgcgcatac

SEQ ID NO: 236020 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtatttcgcatgc

SEQ ID NO: 236021 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcatcc

SEQ ID NO: 236022 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtgggattgcgcatgc

SEQ ID NO: 236023 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgctcatgc

SEQ ID NO: 236024 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgaggtattgcgcatgc

SEQ ID NO: 236025 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggtgttgcgcatgc

SEQ ID NO: 236026 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcatcttgtggtattgcgcatgc

SEQ ID NO: 236027 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtactcttgtggtattgcgcatgc

SEQ ID NO: 236028 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtccttcttgtcgtatgcgcatagc

SEQ ID NO: 236029 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtccttctcgtgtattgcgcatgtc

SEQ ID NO: 236030 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtattgcgcatgcc

SEQ ID NO: 236031 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtcctcctgtggtattgcgcatgc

SEQ ID NO: 236032 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcgagcgatcgtcgtaatactgcctccaa

SEQ ID NO: 236033 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcagtttgtccgtcctcttgtggtattgcgcatgc

SEQ ID NO: 236034 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactagccgtttgtccgtcctcttgtggtattgcgcatgc

SEQ ID NO: 236035 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactacccgcttgtccgtcctcttgtggtattgcgcatgc

SEQ ID NO: 236036 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attacagcgcccagaatgccccgtttcccgtgttcgggac

SEQ ID NO: 236037 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtggctttaagcacttctcggtaacttgggcagttac

SEQ ID NO: 236038 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggatgctttaagcacttctcggtaacttgggcagttac

SEQ ID NO: 236039 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcgtcgtttaaccgtttgttgcaa

SEQ ID NO: 236040 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acaagattcatctttgcttgactacacgcaattccgatga

SEQ ID NO: 236041 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttgggaagcagaactggtcgaggcgctatcctcgactta

SEQ ID NO: 236042 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttctcgcctctgtcctcatggttcgaaccggtatgcatg

SEQ ID NO: 236043 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtggggcttttaagcacttctcggtaacttggcagttac

SEQ ID NO: 236044 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgcgactacgctcttgaacaattctgatccctggactt

SEQ ID NO: 236045 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggcttttaagcacttctcggtaacttgggcagtta

SEQ ID NO: 236046 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggctttaagcacttctcggtaacttgagcagttac

SEQ ID NO: 236047 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgagaaacgctattttctgggaagccgcatctcgagcgaa

SEQ ID NO: 236048 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagactaccactgatcacgtcg

SEQ ID NO: 236049 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttcgccagccacatcaactatgatgacgcttgactgga

SEQ ID NO: 236050 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccgtctggtcgcgatacagaatacgattaacataaa

SEQ ID NO: 236051 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccattctggtcgcgatacagaatacgattaacataa

SEQ ID NO: 236052 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggttgcgatacagaatacgattaacataaa

SEQ ID NO: 236053 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatatagaatacgattaacataaa

SEQ ID NO: 236054 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgattaacatagg

SEQ ID NO: 236055 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgatcaacataaa

SEQ ID NO: 236056 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgataaacataaa

SEQ ID NO: 236057 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgactaacataaa

SEQ ID NO: 236058 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcacgatacagaatacgattaacataaa

SEQ ID NO: 236059 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctgtaggcacctgctctatgtcgtggggagtaacaggtt

SEQ ID NO: 236060 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgttccatctggtcgcgatacagaatacgattaacataa

SEQ ID NO: 236061 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagcttacttcgtctttgatcgaccacgctcataa

SEQ ID NO: 236062 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctctcttcgtctttgatcgaccacgctcataa

SEQ ID NO: 236063 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcgcttcgtctttgatcgaccacgctcataa

SEQ ID NO: 236064 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtttttgatcgaccacgctcataa

SEQ ID NO: 236065 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccacgctcctaa

SEQ ID NO: 236066 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccaagctcataa

SEQ ID NO: 236067 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttaatcgaccacgctcataa

SEQ ID NO: 236068 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtcttgattcgaccacgctcataa

SEQ ID NO: 236069 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttaagcacttctcggtaacttgggctgttac

SEQ ID NO: 236070 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatccatctggtcgcgatacagaatacgattaacataaa

SEQ ID NO: 236071 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgatgcttgactgga

SEQ ID NO: 236072 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccaggcacatcaactatgatgacgcttgactgga

SEQ ID NO: 236073 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcgctctcgtgaacttgggcagttac

SEQ ID NO: 236074 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaacttggcagctac

SEQ ID NO: 236075 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaacttgagcgttac

SEQ ID NO: 236076 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaactcggcagttac

SEQ ID NO: 236077 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttcggtaacttgggcagttacc

SEQ ID NO: 236078 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
tatggggcttttaagcacttccagtaacttgggcagttac

SEQ ID NO: 236079 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcactcctcggtaacttggcagttac

SEQ ID NO: 236080 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaggcacttctcggtaacttgggcagttac

SEQ ID NO: 236081 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttacagcactctcggtaacttgggcagttac

SEQ ID NO: 236082 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctggtaacttgggcagttacc

SEQ ID NO: 236083 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtagcttgggcagttac

SEQ ID NO: 236084 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttgggcaattac

SEQ ID NO: 236085 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttggcagcttac

SEQ ID NO: 236086 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttatacgacttctcggtaacttgggcagttac

SEQ ID NO: 236087 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtagcttgggcagttac

SEQ ID NO: 236088 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacttgtgcagttac

SEQ ID NO: 236089 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcgggtaacttggcagttac

SEQ ID NO: 236090 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttacgacacttctcggtaacttgggcagttac

SEQ ID NO: 236091 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcggtacttggtcgagttac

SEQ ID NO: 236092 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcggtaacctggcgagttac

SEQ ID NO: 236093 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttcttcggtaacttgggcagttac

SEQ ID NO: 236094 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttggagcagttac

SEQ ID NO: 236095 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacgttgggcagttac

SEQ ID NO: 236096 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaaccttggcgagttac

SEQ ID NO: 236097 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaaagcactttctcgggatactggcagttac

SEQ ID NO: 236098 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgaggcttttaagcacttctggtaacttgggcagttac

SEQ ID NO: 236099 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgagcttttaagcacttctcggtaacttgggcagttac

SEQ ID NO: 236100 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatttcggcagagtgctcatgagc

SEQ ID NO: 236101 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgccttttaatctcggcagagtgctcatgagc

SEQ ID NO: 236102 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacgggctttaagctacttctcggtaacttgggcagttac

SEQ ID NO: 236103 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaatgtacgtacgttaagcctcgatccttaggtttgcag

SEQ ID NO: 236104 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtttcttctcctgactacatgagattaataaacgcgc

SEQ ID NO: 236105 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttatcaccctgacatcgcggggaactaatggtt

SEQ ID NO: 236106 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacaccgcggggaactaatggtt

SEQ ID NO: 236107 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatgggctttaagcacttctcggtaacttggtcagttac

SEQ ID NO: 236108 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaggtgcgtaccctctttagccgcctctgaagattggat

SEQ ID NO: 236109 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctgtaggcacctgctctatgtcgtggggagtaacaggtt

SEQ ID NO: 236110 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctgagctttcacgcacgcggattgtacccgaactgggtt

SEQ ID NO: 236111 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgtcacgcggactgtaccgaactgggtt

SEQ ID NO: 236112 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtacccgaactaggtt

SEQ ID NO: 236113 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtacccaaactgggtt

SEQ ID NO: 236114 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggcttcacgcacgcggattgtacccgaactggggtt

SEQ ID NO: 236115 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggcttcacgcacgcggattgtacccgaacgtgggtt

SEQ ID NO: 236116 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctagactttcacgcacgcggattgtacccgaactgggtt

SEQ ID NO: 236117 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctacggctttcacgcactgcggattgacccgaactggtt

SEQ ID NO: 236118 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttcttctccgtgactacatgagattaataaacgcgc

SEQ ID NO: 236119 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttcttcgtcctgactacatgagattaactaaacgcgc

SEQ ID NO: 236120 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgattacatgagattaataaacgcgc

SEQ ID NO: 236121 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattaataaacgcga

SEQ ID NO: 236122 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttcctctgactacatgagattaataaacgcgc

SEQ ID NO: 236123 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggattcttctctcgactacatgagattaataaacgcgc

SEQ ID NO: 236124 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcattgggtcggtttggtgggggactacccccttgta

SEQ ID NO: 236125 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggttggttttggtgggggactacccccttgta

SEQ ID NO: 236126 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcgattttggtgggggactacccccttgta

SEQ ID NO: 236127 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatggatcggttttggtgggggactacccccttgta

SEQ ID NO: 236128 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactacccgtatcgagctagtcttatgctactggcaatca

SEQ ID NO: 236129 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcaggacgtctttctgcactatcacgatt

SEQ ID NO: 236130 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcagacgtctttctgcgactatcacgatt

SEQ ID NO: 236131 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggccgtctttcgtgcactatcacgatt

SEQ ID NO: 236132 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtatttcgtgcactatcacgatt

SEQ ID NO: 236133 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttatccgtcctcttgtggtattgcgcatgc

SEQ ID NO: 236134 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtctgtccgtcctcttgtggtattgcgcatgc

SEQ ID NO: 236135 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgaacagtgtgccgttttcgatg

SEQ ID NO: 236136 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgaacagtgtgccgctttcggtg

SEQ ID NO: 236137 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggttcttcgataatacgcaaca

SEQ ID NO: 236138 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtctctggttaaacaacga

SEQ ID NO: 236139 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccatctgcatcgagcgagatcgtgtgaaatggcaagcg

SEQ ID NO: 236140 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgactatccgttgtccgtcctcttgtggtattgcgcatgc

SEQ ID NO: 236141 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccttccatctggtcgcgatacagaatacgattaacataaa

SEQ ID NO: 236142 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcagctagtcgtgctttgtccgccatgacattca

SEQ ID NO: 236143 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcgccccgatagtcatcttcgctggaccacccgcgtta

SEQ ID NO: 236144 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttcagtcctggtggtaccacaacgcattgctcttt

SEQ ID NO: 236145 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctgggatcactctctacgcgtataaatgccctgtca

SEQ ID NO: 236146 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacctcgatagtcatcttcgctggaccacccgtgtta

SEQ ID NO: 236147 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccgatagtcatcttcacttggaccacccgtgtta

SEQ ID NO: 236148 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccctgatagtcatcttcactggaccaccgtgtta

SEQ ID NO: 236149 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccggtagtcatcttcactggaccacccgtgtta

SEQ ID NO: 236150 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgctagtcatcttcgctggaccacccgtgtta

SEQ ID NO: 236151 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgattagtcatcttcgctggaccaccgcgtta

SEQ ID NO: 236152 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcgtcttcgctggaccacccgcgtta

SEQ ID NO: 236153 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggaccacccttgtta

SEQ ID NO: 236154 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggacacccgtgttac

SEQ ID NO: 236155 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggacaccccgtgtta

SEQ ID NO: 236156 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcaccggaccacccgtgtta

SEQ ID NO: 236157 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatctacactggaccacccgtgtta

SEQ ID NO: 236158 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcgttcactggacacccgtgtta

SEQ ID NO: 236159 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcaccttcgctggaccacccgcgtta

SEQ ID NO: 236160 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagctcatcttcactggaccaccgtgtta

SEQ ID NO: 236161 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgacttagtcatcttcactggacaccgtgtta

SEQ ID NO: 236162 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgacaccccgatagtcatcttcactggacacccgtgtta

SEQ ID NO: 236163 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccaagtccccaattcgtcgtccgtacgctattacggttt

SEQ ID NO: 236164 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtgcgctttatggagccgggtaccttccagcaagg

SEQ ID NO: 236165 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtgcgccttatggagccgggtaccttccagcaagg

SEQ ID NO: 236166 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattggtgcgcttatggagccgggtaccttccagcaagg

SEQ ID NO: 236167 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catggggcttttaagcacttctcggtaacttggcagttac

SEQ ID NO: 236168 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagctatccgttgtccgtcctctcgtggtattgcgcatgc

SEQ ID NO: 236169 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactttccgtttgtccgtcctcttgtggtattgcgcatgc

SEQ ID NO: 236170 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcatat

SEQ ID NO: 236171 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggcattgcgcacgc

SEQ ID NO: 236172 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtgctattgcgcatgc

SEQ ID NO: 236173 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgcgcttgc

SEQ ID NO: 236174 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgcccatgc

SEQ ID NO: 236175 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggaattgcgcatgc

SEQ ID NO: 236176 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggtattgcgcacgc

SEQ ID NO: 236177 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcacgtggtattgcgcatgc

SEQ ID NO: 236178 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgccctcttgtggtattgcgcacgc

SEQ ID NO: 236179 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgccctcctgtggtattgcgcatgc

SEQ ID NO: 236180 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttggccgtcctcttgtggtattgcgcatgc

SEQ ID NO: 236181 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttggccgtcctctcgtggtattgcgcatgc

SEQ ID NO: 236182 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgttccgtcctcttgtggtattgcgcatgc

SEQ ID NO: 236183 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtccttcttgtgtacttgcgcatgc

SEQ ID NO: 236184 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtccttctgtggtattgcgcatgtc

SEQ ID NO: 236185 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctccttgtggtattgcgcatgc

SEQ ID NO: 236186 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttagtccgtcctcttgtggtattgcgcatgc

SEQ ID NO: 236187 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtcctcttatggtattgcgcatgc

SEQ ID NO: 236188 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcagcaagcggctaaggcc

SEQ ID NO: 236189 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcaactagcggctaaggcc

SEQ ID NO: 236190 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcactacgcgtatggaacc

SEQ ID NO: 236191 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcttcttgtggtattgcgcatgc

SEQ ID NO: 236192 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtggtattgtgcatgc

SEQ ID NO: 236193 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtggtaatgcgcatgc

SEQ ID NO: 236194 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtggcattgcgcatgc

SEQ ID NO: 236195 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgctcgtccgtcctcttgtggtattgcgcatgc

SEQ ID NO: 236196 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgattgtccgtcctcttgtggtattgcgcatgc

SEQ ID NO: 236197 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactaaccgtttgtccgtcctcttgtggtattgcgcatgc

SEQ ID NO: 236198 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgatccgtttgtccgtcctcttgtggtattgcgcatgc

SEQ ID NO: 236199 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attgtaggcacctgctctatgtcgtggggagtaacaggtt

SEQ ID NO: 236200 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccggcgacttcggtggtgtcctctccattacca

SEQ ID NO: 236201 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttcggtggtgtcctctcaattacca

SEQ ID NO: 236202 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttcagtggtgtcctctccattacca

SEQ ID NO: 236203 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtgccatgagcttctggcactatccagttgacgctca

SEQ ID NO: 236204 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactagtccagttgacgctca

SEQ ID NO: 236205 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgggtccatgagcttctggcactatccagttgacgctca

SEQ ID NO: 236206 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
atgaccgggcccgcctcaagctagctacctccattgtctg

SEQ ID NO: 236207 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcataatataatacgtctg

SEQ ID NO: 236208 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agaggcttttaagcacttctgacggtgttcttattgactc

SEQ ID NO: 236209 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actcttggaacctcatcaattgcgtccggtttcgacccat

SEQ ID NO: 236210 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actaattccagcgacttcggtggtgtcctctccattacca

SEQ ID NO: 236211 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactgttccggtaagtcatcgtttaaccgtttgttgcaa

SEQ ID NO: 236212 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttagccgtttgttgcaa

SEQ ID NO: 236213 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcaccgtttaaccgtttgttgcaa

SEQ ID NO: 236214 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggcaagtcatcgtttaaccgtttgttgcaa

SEQ ID NO: 236215 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatggggcttttaagcacttctggtaacttgggcagttac

SEQ ID NO: 236216 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgggctttaagcacttctcggtaacttgggcagttacc

SEQ ID NO: 236217 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccggcctcaagctagctacctccattgtctg

SEQ ID NO: 236218 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccgcctcaagctagctacctccattgtctgc

SEQ ID NO: 236219 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgccgcaagctagctacctccattgtctg

SEQ ID NO: 236220 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttttcgccagtcacatcaactatgatgacgcttgactgga

SEQ ID NO: 236221 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttttccatctggtcgcgatacagaatacgattaacataaa

SEQ ID NO: 236222 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttggggctttaagcacttctcggtaacttgggcagttac

SEQ ID NO: 236223 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttgaaggactaccttcttgatacataattgtttctaaca

SEQ ID NO: 236224 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttcccatctggtcgcgatacagaatacgattaacataaa

SEQ ID NO: 236225 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgtgacccgggttgcaattgcctcgtaaccagaccgcat

SEQ ID NO: 236226 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgtcgtcgaaccgccttgatccgccgtagctagctagca

SEQ ID NO: 236227 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgtaccccgggttgcaattgcctcgtaatcagaccgcat

SEQ ID NO: 236228 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgtaccccgggttgcaattgcctcgtaaccagaccgcaa

SEQ ID NO: 236229 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgggtgctttaagcacttctcggtaacttgggcagttac

SEQ ID NO: 236230 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgggtcttttaagcacttctcggtaacttgggcagttac

SEQ ID NO: 236231 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttggctccggagcaatccgccttttgcctgccttaggata

SEQ ID NO: 236232 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttggaatctcggatcgcggatcgttccttctcctccaccg

SEQ ID NO: 236233 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgcaccccgggttgcaattgcctcgtaaccggaccgcat

SEQ ID NO: 236234 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgaatgccttgcttaggcgcctcttaagggatccatttt

SEQ ID NO: 236235 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgaatcctgctctaggcgcctcttaagggatccattttt

SEQ ID NO: 236236 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcttatccggcaggacgtctttcgtgcgctatcacgatt

SEQ ID NO: 236237 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcttatccagcaggacgtctttcgtgcactatcacgatt

SEQ ID NO: 236238 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttctatccggctaggacgtctttcgtgcactatcacgatt

SEQ ID NO: 236239 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcggcgggtctgccacgtcccccgaagatgttgtttggt

SEQ ID NO: 236240 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcgcgatagtcctcggttcttccatgcagctgcatatta

SEQ ID NO: 236241 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttccggtgaagctaactctttggcccgctatggccataaa

SEQ ID NO: 236242 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttccgggtacgctcgactacgaccggtacaccctgtactg

SEQ ID NO: 236243 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcaggtcctcgggccgcatgtattagtgttgcaactcta

SEQ ID NO: 236244 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttatgacgttcggttcgcctcgggtccatccaattgtctg

SEQ ID NO: 236245 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttatccctgatgatccgaattctcatcggctgcactatcc

SEQ ID NO: 236246 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttagcgactacgctatctaacgcatccgtagttctgtcgc

SEQ ID NO: 236247 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgtaacgttacagtcgtctctaaactgcagtgcaacct

SEQ ID NO: 236248 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtggggcttctagcacttctcggtaacttgggcagttac

SEQ ID NO: 236249 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgggctttaagctacttctcggtaacttgggcagttgc

SEQ ID NO: 236250 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgggctttaagcacttctcggtaacttgggcagcttac

SEQ ID NO: 236251 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtggcgttttaagcacttctcggtaacttgggcagttac

SEQ ID NO: 236252 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgcggttttaagcacttctcggtaacttgggcagttac

SEQ ID NO: 236253 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgcgactacgtctcttgaacaattctgatcctggattt

SEQ ID NO: 236254 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgcgactacgctcttgaacaattctggtccctggattt

SEQ ID NO: 236255 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgcgactacgcccttgaacaattctgatccctggattt

SEQ ID NO: 236256 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgcgactacactcttgaacaattctgatccctggattt

SEQ ID NO: 236257 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgccactacgctcttgaacaactctgatccctggattt

SEQ ID NO: 236258 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtcggagccgttatgcactatcataaggaagactccatt

SEQ ID NO: 236259 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtccctcctatctgctttttcagactactgaatgcacgg

SEQ ID NO: 236260 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtccctcctatctgctttttcagactactgaacgcacgg

SEQ ID NO: 236261 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtattctcgggcctttattcttcccaaaacgccgcaccg

SEQ ID NO: 236262 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtagtatcgttcttatccgcctcggtcttcccaggttaa

SEQ ID NO: 236263 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcctcgatcttctataccgtctg

SEQ ID NO: 236264 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcctcgatcctctataccttctg

SEQ ID NO: 236265 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcctcgatcctctataccgtttg

SEQ ID NO: 236266 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcctcgatcctctaaaccgtctg

SEQ ID NO: 236267 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcctcgaccctctataccgtctg

SEQ ID NO: 236268 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgccccgatcctctataccgtctg

SEQ ID NO: 236269 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcacctggtccgcctcgatcctctataccgtctg

SEQ ID NO: 236270 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtagatcgttcttatccacctcggtcttccccgggttaa

SEQ ID NO: 236271 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtagatcgcctggtccgcctcgatcctctataccgtctg

SEQ ID NO: 236272 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaagtcgcctggtccgcctcgatcctctataccgtctg

SEQ ID NO: 236273 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggggtatgcgtgtttcctccaagcaccgcctcgctaacg

SEQ ID NO: 236274 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggcgaaacgctatttctgggaagccgcatctcgagcgaa

SEQ ID NO: 236275 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggactacccccgggtaagtcgtccttgagacatgtgctg

SEQ ID NO: 236276 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgctaaacgctattttctgggaagccgcatctcgagcgaa

SEQ ID NO: 236277 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgtaaacgctattttctgggagccgcatctcgagcgaa

SEQ ID NO: 236278 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgtaaacgctatttctgggagccgcatctcgagctgaa

SEQ ID NO: 236279 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcggaacgctattttctgggaagccgcgtctcgagcgaa

SEQ ID NO: 236280 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttggttcactcctacagtgtgtctataga

SEQ ID NO: 236281 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgattctctcctacagtgtgtctataga

SEQ ID NO: 236282 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaacgctatttctcgggaagccgcatcgtcgagcgaa

SEQ ID NO: 236283 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaacgctatttctcggaagccgctagtctcgagcgaa

SEQ ID NO: 236284 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaccgctattttctgggaagccgcgtctcgagcgaa

SEQ ID NO: 236285 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgtctatttctgggaagccgcgtctcgagcgaa

SEQ ID NO: 236286 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttttgggaagccacgtctcgagcgaa

SEQ ID NO: 236287 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggtagccgcatctcgagcgaa

SEQ ID NO: 236288 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaggccgcgtctcgagcgaa

SEQ ID NO: 236289 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagcctcatctcgagcgaa

SEQ ID NO: 236290 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcgtcttgagcgaa

SEQ ID NO: 236291 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcgtctcgggcgaa

SEQ ID NO: 236292 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatcttgagcgaa

SEQ ID NO: 236293 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatctcgagcgca

SEQ ID NO: 236294 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatctcgagcaaa

SEQ ID NO: 236295 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatctcgagagga

SEQ ID NO: 236296 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatctcgagagaa

SEQ ID NO: 236297 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatcccaagcgaa

SEQ ID NO: 236298 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcagctcgagcgaa

SEQ ID NO: 236299 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctggaatgccgcatctcgagcgaa

SEQ ID NO: 236300 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgagaagccgcgtctcgagcgaa

SEQ ID NO: 236301 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctaggaagccgcatctcgagcgaa

SEQ ID NO: 236302 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttcgatggagccgcatctcgagcgaa

SEQ ID NO: 236303 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttcctgggaaccgctgtctcgagcga

SEQ ID NO: 236304 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttctgggaagccggcatctcgagcgaa

SEQ ID NO: 236305 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttctgggaagccgcatctcgagccgaa

SEQ ID NO: 236306 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttctcgggaagccgcgtctcgagcgaa

SEQ ID NO: 236307 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatgttctgggaagccgcatctcgagcgaa

SEQ ID NO: 236308 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctagtttctgggaagccgcatctcgagcgaa

SEQ ID NO: 236309 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgcgattttctgggaagccgcatctcgagcgaa

SEQ ID NO: 236310 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgccttcgatcctcgcataatatgatacgtctg

SEQ ID NO: 236311 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgccattttctgggaagccgcatctcgagcgga

SEQ ID NO: 236312 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgatattttctgggaagccgcatctcgagcgaa

SEQ ID NO: 236313 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacactattttctgggaaaccgcatctcgagcgaa

SEQ ID NO: 236314 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaaagctattttctgggaagccgcatctcgagcgaa

SEQ ID NO: 236315 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcagaacgctattttctgggaagccgcatctcgagcgaa

SEQ ID NO: 236316 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgattggctttagcacttctcgtaacttggtacaagttac

SEQ ID NO: 236317 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgattggctttacgcacttctcgtaactggtacaagtgac

SEQ ID NO: 236318 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgattcgccagtcacatcaactatgatacgcttgactgga

SEQ ID NO: 236319 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatggggctttaagcacttctcgtaacttgggcagttac

SEQ ID NO: 236320 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggcttttaagcacttctggtgacttgggcagttac

SEQ ID NO: 236321 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggcttttaagcacttctggtaacttgggcagttac

SEQ ID NO: 236322 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggcttttaagcacttctcggtacttgggcagttac

SEQ ID NO: 236323 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggcttttaagcacttctcggtaacttgggcattac

SEQ ID NO: 236324 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggcttttaagcactctcggtaacttgggcagttac

SEQ ID NO: 236325 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggctttatacacttctcggtaacttgggcagttac

SEQ ID NO: 236326 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggctttagcacttctcgtaacttgggacagcttac

SEQ ID NO: 236327 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggctttagacacttctcggtaacttgggcagttac

SEQ ID NO: 236328 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggctttacacacttctcggtaacttgggcagttac

SEQ ID NO: 236329 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggctttaagcgacttctcggtaacttggcagttac

SEQ ID NO: 236330 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggctttaagcacttctcgttaacttgggcagttac

SEQ ID NO: 236331 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggctttaagcacttctcggtaacttaggcagttac

SEQ ID NO: 236332 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggctttaagcactcctcggtaacttgggcagttac

SEQ ID NO: 236333 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggctttaagaacttctcggtaacttgggcagttac

SEQ ID NO: 236334 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
tgatgggcgtttaagcacttctcggtaacttggcagttac

SEQ ID NO: 236335 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatggcttttaagcacttctcggtaaccttggcagttac

SEQ ID NO: 236336 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatggctttaagctacttctcggtaacttgggcagttac

SEQ ID NO: 236337 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatggctttaagcacttctcggtaaccgttggcagttac

SEQ ID NO: 236338 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatggctttaacgctacttctcggtacttgggcagttac

SEQ ID NO: 236339 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatggcgtttaaagcactttctgggataccgtggcagta

SEQ ID NO: 236340 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgagcgtaaacgctatttccggagccgcgtctcgagcgaa

SEQ ID NO: 236341 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgactttatccgacggatctcacgttccccttggttcggg

SEQ ID NO: 236342 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaccgctcatctatcggacacgacgtcgtatcagtgctg

SEQ ID NO: 236343 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcgtttacactagactactactgatcacgtcg

SEQ ID NO: 236344 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactggactactactgatcacgtcg

SEQ ID NO: 236345 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagattactactgatcacgtcg

SEQ ID NO: 236346 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagactactactgatcatgtcg

SEQ ID NO: 236347 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagactactactgatcacgacg

SEQ ID NO: 236348 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagactactactgatcacatcg

SEQ ID NO: 236349 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagactactactgataacgtcg

SEQ ID NO: 236350 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagactactaccgatcacgtcg

SEQ ID NO: 236351 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactaaactactactgatcacgtcg

SEQ ID NO: 236352 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttaactagactactactgatcacgtcg

SEQ ID NO: 236353 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggttctactagactactactgatcacgtcg

SEQ ID NO: 236354 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggttcactaggactactactgatcacgtcg

SEQ ID NO: 236355 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttgctagcggatccgatctcgatcccccatgcgctgta

SEQ ID NO: 236356 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttgcgagtctgttttcgcgcactatcgcgatctaagca

SEQ ID NO: 236357 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttctatctggtcgcgatacagaatacgattaacataaa

SEQ ID NO: 236358 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttctatctggtcgcgatacagaatacgattaacaaaaa

SEQ ID NO: 236359 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccattctgtcgcgatacagaatacgattaacataaa

SEQ ID NO: 236360 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatcttgtcgcgatacagaatacgattaacataaa

SEQ ID NO: 236361 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctgttcgcgatacagaatacgattaacataaa

SEQ ID NO: 236362 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctgtcgccgatacagaatacgattaacataaa

SEQ ID NO: 236363 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggttgcgatacagaatacaattaacataaa

SEQ ID NO: 236364 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggttcgcgatacagaatacgattaacataa

SEQ ID NO: 236365 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgctatacagaatacgattaacataaa

SEQ ID NO: 236366 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatgcagaatacgattaacataaa

SEQ ID NO: 236367 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacggaatacgatcaacataaa

SEQ ID NO: 236368 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacaggatacgattaacataaa

SEQ ID NO: 236369 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatgcgattaacataaa

SEQ ID NO: 236370 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatatgattaacataaa

SEQ ID NO: 236371 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatactattaacataaa

SEQ ID NO: 236372 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgattagcatgaa

SEQ ID NO: 236373 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgattagcacaaa

SEQ ID NO: 236374 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgattaagataaa

SEQ ID NO: 236375 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgattaacataca

SEQ ID NO: 236376 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgataaacgtaaa

SEQ ID NO: 236377 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacaattaacatgaa

SEQ ID NO: 236378 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaataagattaacataaa

SEQ ID NO: 236379 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaacacgattaacataaa

SEQ ID NO: 236380 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacaaaatacgattatcataaa

SEQ ID NO: 236381 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacaaaatacgattaacataaa

SEQ ID NO: 236382 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgccgatacagaatacgattaacataa

SEQ ID NO: 236383 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgagatacagaatacgattaacataaa

SEQ ID NO: 236384 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggccgcgatacagaatacaattaacgtaag

SEQ ID NO: 236385 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctgatcgcgatacagaatacgattaacataaa

SEQ ID NO: 236386 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctagtcgcgatacagaatacgattaacataaa

SEQ ID NO: 236387 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatcgggtcgcgatacagaatacgattaacataaa

SEQ ID NO: 236388 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccaactggtcgcgatacagaatacgattaacataaa

SEQ ID NO: 236389 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctcccatctggtcgcgatacagaatacgattaacataaa

SEQ ID NO: 236390 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctcccatctggtcgcgatacagaatacgattaacaaata

SEQ ID NO: 236391 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctcccaagtttagtcgcctttcgaggactacctcgtttc

SEQ ID NO: 236392 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctccatctgtcgcgatatcagaataccgattaacataaa

SEQ ID NO: 236393 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctccatctgtcgcgatatcagaataccgattaacacaaa

SEQ ID NO: 236394 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctccatctggttcgcgatacagaatacaattaatacaat

SEQ ID NO: 236395 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctccatctggtcgcgatacagtaatacgattaacataaa

SEQ ID NO: 236396 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctccatctcggtcgcgatacagaatacgattaacataaa

SEQ ID NO: 236397 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctaactgcggtgcgcgtctttcagatactactctgatgt

SEQ ID NO: 236398 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgtacagctcacttcatctttgatcgaccacgctcataa

SEQ ID NO: 236399 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcggtcgtatcgtggactaccacagaagaatcgactgtcg

SEQ ID NO: 236400 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgggatacttgaggtcgttgcgcgcttacgaaccctaat

SEQ ID NO: 236401 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcggatgacttgagtctgttgtgcgcttacgaacccaatt

SEQ ID NO: 236402 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcggatacttgagtcgcttgtgcgcttacgaaaccctaat

SEQ ID NO: 236403 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcggaatacttgaggtcgttgtgcgcttacgaaccctaat

SEQ ID NO: 236404 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcgaaacgctattttctgggaaccgcatctcgagcgaa

SEQ ID NO: 236405 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcatagctcacttcgtctttgatcgaccacgctcacaa

SEQ ID NO: 236406 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcactgctcacttcgtctttgatcgaccacgctcataa

SEQ ID NO: 236407 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcactgctcacttcgtctctgatcgaccacgctcataa

SEQ ID NO: 236408 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcactagctcacttcgtcttgatcgtacacgctcataa

SEQ ID NO: 236409 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcactagctcacttcgtcttgatcgaccacgctcataa

SEQ ID NO: 236410 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacggctaacttcgtctttgatcgaccacgctcataa

SEQ ID NO: 236411 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagcttcacttcgtctttgatcgacacgctcataa

SEQ ID NO: 236412 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcagttcgtctttgatcgaccacgctcataa

SEQ ID NO: 236413 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgattacgctcataa

SEQ ID NO: 236414 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccactctcataa

SEQ ID NO: 236415 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatccaccacgctcataa

SEQ ID NO: 236416 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcaaccacgctcatga

SEQ ID NO: 236417 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctatgatcgaccacgctcataa

SEQ ID NO: 236418 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtcattgatcgaccacgctcataa

SEQ ID NO: 236419 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtatttgatcgaccacgctcataa

SEQ ID NO: 236420 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcggctttgatcgaccacgctcataa

SEQ ID NO: 236421 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcatccttgatcgaccacgctcataa

SEQ ID NO: 236422 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcactcgtcttttgatcgaccacgctcataa

SEQ ID NO: 236423 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcactacgtctttgatcgaccacgctcataa

SEQ ID NO: 236424 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacgtcgtctttgatcgaccacgctcataa

SEQ ID NO: 236425 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagcacacttcgtctttgatcgaccacgctcataa

SEQ ID NO: 236426 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcaaagctcacttcgtctttgatcgaccacgctcataa

SEQ ID NO: 236427 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcctctgtgactctcacactaacccgggggtgtgaccgtc

SEQ ID NO: 236428 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcctccatctggtcgcgatacagaatacggttaacataaa

SEQ ID NO: 236429 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcctccatctggtcgcgatacagaatacgattgacataaa

SEQ ID NO: 236430 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcctccatctggtcgcgatacagaatacgattagcataaa

SEQ ID NO: 236431 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcctcaatctggtcgcgatacagaatacgattaacataaa

SEQ ID NO: 236432 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccgggtcattgttcactataacattatcgcgccgcgacg

SEQ ID NO: 236433 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccgcctcaggttcccctaacgcgttagccttccggaatg

SEQ ID NO: 236434 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcccacagctcacttcgtctttgatcgaccacgctcataa

SEQ ID NO: 236435 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccatggtacgcctcgatttccgccatacatgcatgtaaa

SEQ ID NO: 236436 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccatgggtacgcctcgattccgcccatacatgcatgtaa

SEQ ID NO: 236437 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccatggatccactcggaattcaatttctacgattccgac

SEQ ID NO: 236438 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccaatgaccggatcagggtatatcacaggctactgtgag

SEQ ID NO: 236439 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccaagtccccgattcgtcgtccgtacgctattacggttt

SEQ ID NO: 236440 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccaagtccccaactcgtcgtccgtacgctattacggttt

SEQ ID NO: 236441 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccaaggtccccaattcgtcgtccgtacgctattacggtt

SEQ ID NO: 236442 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcattgtcgcgcttgatggagccggtaccttccagcaatg

SEQ ID NO: 236443 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttagctcaccttctcgtacttggacagttac

SEQ ID NO: 236444 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttagcacttctcggtaacttgggcagcttac

SEQ ID NO: 236445 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttaagctcacttctcgtaacttggcagttac

SEQ ID NO: 236446 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttaagctacttctcgtaacttgggcagttac

SEQ ID NO: 236447 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttaagcacttctcggttacttgggcagttac

SEQ ID NO: 236448 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttaagcacttctcggtaacttggcagcttac

SEQ ID NO: 236449 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttaagcacttcgtcgatacttgggcagttac

SEQ ID NO: 236450 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttaagcactctcggtaacttgggcagcttac

SEQ ID NO: 236451 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatcgccagcacttcacttatcgactgacgcttactaga

SEQ ID NO: 236452 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcagggctttaagctacttctccgtacttggtcgagttac

SEQ ID NO: 236453 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcagaacatgtgtaggtcactatacctagataaactaatt

SEQ ID NO: 236454 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcactatccgttgtccgtcctcttgtggtattgcgcatgc

SEQ ID NO: 236455 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcactataccggcgcggtcgacctttattactttggtcat

SEQ ID NO: 236456 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcacgaaacgctatttctgggaagccgcatctcgagcgaa

SEQ ID NO: 236457 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcacacagctcacttcgtccttgatcgaccacgctcataa

SEQ ID NO: 236458 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcaaagcggtcggaacgctatttccggatttacgcgagac

SEQ ID NO: 236459 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattgggctttagcacttctcgtaacttggtacaagttac

SEQ ID NO: 236460 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattgggctttaagcacttctcgtaacttggtacagttac

SEQ ID NO: 236461 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattgcgccagccacatcaactatgatgacgcttgactga

SEQ ID NO: 236462 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
tattcgcctgccacatcaactatgatgacgcttgactgga

SEQ ID NO: 236463 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccattcacatcaactatgatgacgcttgactgga

SEQ ID NO: 236464 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtctcatcaactatgatgacgcttggctgga

SEQ ID NO: 236465 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtctacatcagctatgatgacgcttgactgg

SEQ ID NO: 236466 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcgacatcaactatgatgacgcttggctga

SEQ ID NO: 236467 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatccactatgatgacgcttgactgga

SEQ ID NO: 236468 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcagctatgatgacgtttgactgga

SEQ ID NO: 236469 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgtcgcttgactgga

SEQ ID NO: 236470 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgactcttgactgga

SEQ ID NO: 236471 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttggctggt

SEQ ID NO: 236472 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttggctggg

SEQ ID NO: 236473 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttgattgga

SEQ ID NO: 236474 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttgactggt

SEQ ID NO: 236475 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttgactagg

SEQ ID NO: 236476 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttgaatgga

SEQ ID NO: 236477 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgctgagctgga

SEQ ID NO: 236478 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgacgtctgactgga

SEQ ID NO: 236479 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgacgcttgactgca

SEQ ID NO: 236480 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgacgcttaactgga

SEQ ID NO: 236481 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgataacgcttgactgga

SEQ ID NO: 236482 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgagtacgcttgactgga

SEQ ID NO: 236483 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacataaactatgatgacgcttgactgga

SEQ ID NO: 236484 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccactcacatcaactatgatgacgcttgactgga

SEQ ID NO: 236485 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcagccacatcaacttatgatgacgcttgactgga

SEQ ID NO: 236486 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcaagccacatcaactatgatgacgcttgactgga

SEQ ID NO: 236487 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattccgccagtcgacatcaactatgactacgctgactga

SEQ ID NO: 236488 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattccatctggtcgcgatacagaatacgattaacataaa

SEQ ID NO: 236489 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcaccagtcacatcaactatgatgacgcttggctgga

SEQ ID NO: 236490 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattagccagccacatcaactatgatgacgcttgactggg

SEQ ID NO: 236491 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggttactttagcacttctcgtaactttgggcagtac

SEQ ID NO: 236492 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggtctttaagcacttctcgtaacttggtcgagttac

SEQ ID NO: 236493 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttttagcacttctggtaacttgggcagttac

SEQ ID NO: 236494 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttttaagcacttctcggtaacttggcagtac

SEQ ID NO: 236495 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttgagcattctcggtaacttgggcagttac

SEQ ID NO: 236496 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttgagcacttctcggtaacttgggcgttac

SEQ ID NO: 236497 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttgagcacttccggtgacttgggcagttac

SEQ ID NO: 236498 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaggcacttctcggtaacttggcagttac

SEQ ID NO: 236499 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaggcacttccggtaacttgggcagttac

SEQ ID NO: 236500 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttagcgacttctcggtaacttggcagttac

SEQ ID NO: 236501 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttagcacttcttggtaacttgggcagttac

SEQ ID NO: 236502 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttagcacttctcggtaacttgggcagttgc

SEQ ID NO: 236503 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttagcacttctcggcaacttgggcagttac

SEQ ID NO: 236504 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttagcacttctcgataacttgggcagttac

SEQ ID NO: 236505 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttagcacttctcgagaacttgggcagttac

SEQ ID NO: 236506 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttagcacttcacggtaacttgggcagttac

SEQ ID NO: 236507 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttagcacctctcggtaacttgggcagttac

SEQ ID NO: 236508 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaatcacttctcggtaacttggcagttac

SEQ ID NO: 236509 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagtactctctgtgacttgggcagttac

SEQ ID NO: 236510 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagtactctcggtaacttgggcagttac

SEQ ID NO: 236511 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcgcttctcggtaacttgggcagtta

SEQ ID NO: 236512 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcgctcttcgtgacttgggcagttac

SEQ ID NO: 236513 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcgctctcgttgacttgggcagttac

SEQ ID NO: 236514 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcgctctcgtgagcttgggcagttac

SEQ ID NO: 236515 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcgacttctcggtacttggcagttac

SEQ ID NO: 236516 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcctctctgtgaacttgggcagttac

SEQ ID NO: 236517 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcattctcggtacattgggcagttac

SEQ ID NO: 236518 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcactttcgtgatacttgggcattac

SEQ ID NO: 236519 - skipped

SEQ ID NO: 236520 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttcttggtaacttgggcagtac

SEQ ID NO: 236521 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttcttggtaacttggcagttac

SEQ ID NO: 236522 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttcttggtaactgggcagttac

SEQ ID NO: 236523 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctggtgacttggtcagttac

SEQ ID NO: 236524 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctggtaacttgggcagttag

SEQ ID NO: 236525 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctggtaacttgggcagctac

SEQ ID NO: 236526 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctggtaacttgggcaattac

SEQ ID NO: 236527 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctggtaacttaggcagttac

SEQ ID NO: 236528 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctggtaactcgggcagttac

SEQ ID NO: 236529 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctgggtaacttggcagttac

SEQ ID NO: 236530 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctggcaacttgggcagttac

SEQ ID NO: 236531 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctgataacttgggcagttac

SEQ ID NO: 236532 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctctgaacttgggcagttac

SEQ ID NO: 236533 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcgtagcttgggcagttac

SEQ ID NO: 236534 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcgtaacttgggtagttac

SEQ ID NO: 236535 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcgtaacttgggctagtac

SEQ ID NO: 236536 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcgtaacttggcgagttac

SEQ ID NO: 236537 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtacttggcgagttac

SEQ ID NO: 236538 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaacttgggcggtta

SEQ ID NO: 236539 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaacttgggcggtac

SEQ ID NO: 236540 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaacttggctgttac

SEQ ID NO: 236541 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaacttggcagtgac

SEQ ID NO: 236542 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaacttggacagtta

SEQ ID NO: 236543 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaacttgagagttac

SEQ ID NO: 236544 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaactgtgcagttac

SEQ ID NO: 236545 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaactgggcagttaa

SEQ ID NO: 236546 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaactggcgagttac

SEQ ID NO: 236547 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaactgagcagttac

SEQ ID NO: 236548 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaactcgggcagtta

SEQ ID NO: 236549 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaacatggcagttac

SEQ ID NO: 236550 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcgggacttgggcagttac

SEQ ID NO: 236551 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggcaacttgggcagtta

SEQ ID NO: 236552 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggaacttgggcagttac

SEQ ID NO: 236553 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcagtacttgggcagttac

SEQ ID NO: 236554 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcagtaactgggcagttac

SEQ ID NO: 236555 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctagtaacttgggcagttac

SEQ ID NO: 236556 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctaggtaacttggcagttac

SEQ ID NO: 236557 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttcgtcgatacttggcagttac

SEQ ID NO: 236558 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttcgtcgacttgggcagcttac

SEQ ID NO: 236559 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttcgtaagacttgggcagttac

SEQ ID NO: 236560 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttcgcggtaacttggcagttac

SEQ ID NO: 236561 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttcgatgtacttgggcagttac

SEQ ID NO: 236562 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttccgtgacattgggcagttac

SEQ ID NO: 236563 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttccgtcgacttgggcagttac

SEQ ID NO: 236564 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttccggtaacttgggtagttac

SEQ ID NO: 236565 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttccggtaactagggcagttac

SEQ ID NO: 236566 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttcccggtaacttggcagttac

SEQ ID NO: 236567 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcactgtctacgtacgtggcagttac

SEQ ID NO: 236568 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcactctcgtacgttagtcgagttac

SEQ ID NO: 236569 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcactctcggtgacttgggcagttac

SEQ ID NO: 236570 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcactctcggtaacttgagcagttac

SEQ ID NO: 236571 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcactctcagtaacttgggcagttac

SEQ ID NO: 236572 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcactcctggtaacttgggcagttac

SEQ ID NO: 236573 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcactcctcggtaacttgggcagtta

SEQ ID NO: 236574 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcactactcgtaacgttggcagttac

SEQ ID NO: 236575 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacattcggtaacttgggcagttac

SEQ ID NO: 236576 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagaactctcggtaacttgggcagttac

SEQ ID NO: 236577 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaaacactctcggtaacttgggcagttac

SEQ ID NO: 236578 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttgagcacttctcggtaacttaggcagttac

SEQ ID NO: 236579 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttgagcacttctaggtaacttgggcagttac

SEQ ID NO: 236580 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttcaagcacttctggtaacttgggcagttac

SEQ ID NO: 236581 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttcaagcacttctcggtaacttggcagttac

SEQ ID NO: 236582 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttagacacttctcggtagcttgggcagttac

SEQ ID NO: 236583 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttagacacttctcggtaacttggtcagttac

SEQ ID NO: 236584 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttagacacttctcggtaacttgggcagctac

SEQ ID NO: 236585 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttagacacttctcggtaacttgagcagttac

SEQ ID NO: 236586 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttagacacttctcggtaacttaggcagttac

SEQ ID NO: 236587 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttactagcacttctcggtaactggcagttac

SEQ ID NO: 236588 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttactagacttctcggtaacttggcagttac

SEQ ID NO: 236589 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttacagcacttctggtaacttgggcagttac

SEQ ID NO: 236590 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
tatggggctttacagcacttctcggtaacttgggcagtac

SEQ ID NO: 236591 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttacagcacttctcggtaacttggcagttac

SEQ ID NO: 236592 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttacagacctctcggtaacttgggcagttac

SEQ ID NO: 236593 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttacacacttctcggtaacttaggcagttac

SEQ ID NO: 236594 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaatagacttctcggtaactgggcagttac

SEQ ID NO: 236595 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagtcacttctcggatacttggcagttac

SEQ ID NO: 236596 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagtacttctcggtaacttggacagttac

SEQ ID NO: 236597 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcgctctcgtgatacttgggcagttac

SEQ ID NO: 236598 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttttcggtaacttgagcagttac

SEQ ID NO: 236599 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcactttcgtgatacttgggcagttac

SEQ ID NO: 236600 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttcttggtaactcgggcagttac

SEQ ID NO: 236601 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttcttggcaacttgggcagttac

SEQ ID NO: 236602 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcgtgaacttggcgagttac

SEQ ID NO: 236603 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcgtaacttgagcagcttac

SEQ ID NO: 236604 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtgacttgagcagttac

SEQ ID NO: 236605 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtacttggggcagttac

SEQ ID NO: 236606 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttgggctgttac

SEQ ID NO: 236607 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttgggctattac

SEQ ID NO: 236608 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttgggcagttaa

SEQ ID NO: 236609 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttgggcagctta

SEQ ID NO: 236610 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacgtgggcagttac

SEQ ID NO: 236611 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacatgagcagttac

SEQ ID NO: 236612 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggaaacttgggcagttac

SEQ ID NO: 236613 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttcgtcgatacttgggcagttac

SEQ ID NO: 236614 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttccgtcgtacttgggcagttac

SEQ ID NO: 236615 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcactctcggtaacttgggcagcttac

SEQ ID NO: 236616 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacctctcggtaacctgggcagttac

SEQ ID NO: 236617 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacatctcggtaacttgggcagttac

SEQ ID NO: 236618 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcaacttctcggtaactcggcagttac

SEQ ID NO: 236619 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaacgcacttctcggtaacttggcagttac

SEQ ID NO: 236620 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttctaagcacttctcgtaacttgggcagttac

SEQ ID NO: 236621 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttctaagcacttctcggtaacttgggcgttac

SEQ ID NO: 236622 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttctaagcacttctcggtaacttgggcagtta

SEQ ID NO: 236623 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttctaagcacttccggtaacttgggcagttac

SEQ ID NO: 236624 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttatagcacttctcggtaacttggtcagttac

SEQ ID NO: 236625 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttatagcacttctcggtaacttgggcagtaac

SEQ ID NO: 236626 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttatagcacttctcggtaacttaggcagttac

SEQ ID NO: 236627 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttatacacttctcggtaacttgggcagttacc

SEQ ID NO: 236628 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttactacacttctcggtaacttgggcagttac

SEQ ID NO: 236629 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttaatacacttctcggtaacttgggcagttac

SEQ ID NO: 236630 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctcttaagcacttctcggtaacttgggcagtta

SEQ ID NO: 236631 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcctttaggcacttctcggtacttgggcagttac

SEQ ID NO: 236632 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcctttaagcacttctcggtgacttggcagttac

SEQ ID NO: 236633 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcctttaagcacttctcggtaacttgggcagtac

SEQ ID NO: 236634 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcctttaagcacttccggtaacttgggcagttac

SEQ ID NO: 236635 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggccttacacacttctcggtaacttgggcagttac

SEQ ID NO: 236636 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcatttaagcactctcggtaacttgggcagttac

SEQ ID NO: 236637 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttgagcacttctcggtagcttgggcagttac

SEQ ID NO: 236638 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaggcacttctcggtaacttgggcagttac

SEQ ID NO: 236639 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttagcgacttctcggtaacttggcgagttac

SEQ ID NO: 236640 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagtcacttctcggtaacttggcagttac

SEQ ID NO: 236641 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagctacttctcgtaacttggcgagttac

SEQ ID NO: 236642 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcgctctcgtgatacttgggcagttac

SEQ ID NO: 236643 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcgtacgttaggcgagttac

SEQ ID NO: 236644 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcgtaacttgagcaagttac

SEQ ID NO: 236645 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtgacttgggcagttac

SEQ ID NO: 236646 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtacttgggcaagttac

SEQ ID NO: 236647 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtacattgggcagttac

SEQ ID NO: 236648 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacttgggccgttac

SEQ ID NO: 236649 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacttgggacattac

SEQ ID NO: 236650 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacttggcaagttac

SEQ ID NO: 236651 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaactagggcagttac

SEQ ID NO: 236652 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaaccttggcagttac

SEQ ID NO: 236653 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctaggtaacttgggcagttac

SEQ ID NO: 236654 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcactctcgtacgttaggtcgagttac

SEQ ID NO: 236655 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacctctcggttacttgggcagttac

SEQ ID NO: 236656 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttgagtcacttctcggtaacttgggcagttac

SEQ ID NO: 236657 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttgagccacttctcggtaacttgggcagttac

SEQ ID NO: 236658 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttgagcacttctcggttaacttgggcagttac

SEQ ID NO: 236659 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttgagcacttctcggtaacttgggcagttacc

SEQ ID NO: 236660 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttgagcacttctcggtaacttgggcagcttac

SEQ ID NO: 236661 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttagctacttctcggtaacttgggcgagttac

SEQ ID NO: 236662 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttagcgtacttctcggtaacttgggcagttac

SEQ ID NO: 236663 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttacagcacttctcggtaacttgggcagttac

SEQ ID NO: 236664 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagtcacttctcggtaacttgggcagttac

SEQ ID NO: 236665 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctatttctcggtaacttgggcagttac

SEQ ID NO: 236666 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctggtaacttgggcgagttac

SEQ ID NO: 236667 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcgtaacttaggcgagttac

SEQ ID NO: 236668 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcggtacttgggcgagttgc

SEQ ID NO: 236669 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcggtacttgggcgagttac

SEQ ID NO: 236670 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcggtacttggcgagttacc

SEQ ID NO: 236671 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcggtacttaggcgagttac

SEQ ID NO: 236672 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcggtaacttggtgagttac

SEQ ID NO: 236673 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcggtaacttggtcagttac

SEQ ID NO: 236674 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcggtaacttggcgaggtac

SEQ ID NO: 236675 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcggtaacttggcgagctac

SEQ ID NO: 236676 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcggtaacttggcagttgac

SEQ ID NO: 236677 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcggtaacgttggcagttac

SEQ ID NO: 236678 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcggtaaccatggcagttac

SEQ ID NO: 236679 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcggcaacttgggcagttac

SEQ ID NO: 236680 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcgataacttgggcagttac

SEQ ID NO: 236681 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttcgtcgtaaccttggcagttac

SEQ ID NO: 236682 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttcggtcaacttgggcgagttac

SEQ ID NO: 236683 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctactcctcggtaacttggcgagttac

SEQ ID NO: 236684 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctaccttctcggtacttggcgagttac

SEQ ID NO: 236685 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcgtcttctcggtaacttgggcagttac

SEQ ID NO: 236686 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcgtctctccgtcgacttgggcagttac

SEQ ID NO: 236687 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcgacttctcggtaacttggtcagttac

SEQ ID NO: 236688 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcgacttctcggtaacttggcgagttac

SEQ ID NO: 236689 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcactttctcggtaacttgggctgttac

SEQ ID NO: 236690 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcactttctcggtaacctgggcagttac

SEQ ID NO: 236691 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcactttctcgggtaacttggacagtac

SEQ ID NO: 236692 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcactttctcgggtaacctggcagttac

SEQ ID NO: 236693 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcactttcgcggtaacttgggcagttac

SEQ ID NO: 236694 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcgtaacttgggacaagttac

SEQ ID NO: 236695 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggttaacttgggccactac

SEQ ID NO: 236696 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggttaacttgggcagctac

SEQ ID NO: 236697 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggttaacttggacagttac

SEQ ID NO: 236698 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggttaacttgagcagttac

SEQ ID NO: 236699 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggttaacttgacgcattac

SEQ ID NO: 236700 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggttaactagggcagttac

SEQ ID NO: 236701 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtgagcttgggcagttac

SEQ ID NO: 236702 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtgaacttgggcagttac

SEQ ID NO: 236703 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtacgcttgggcagttac

SEQ ID NO: 236704 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttgggcagttgac

SEQ ID NO: 236705 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttggacaagttac

SEQ ID NO: 236706 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttgagcagcttac

SEQ ID NO: 236707 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttagggcagttac

SEQ ID NO: 236708 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttaggccagttac

SEQ ID NO: 236709 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaactcgggcagcttac

SEQ ID NO: 236710 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaaacttgggcagttac

SEQ ID NO: 236711 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcgggtgacttgggcagttac

SEQ ID NO: 236712 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggataacttgggcagttac

SEQ ID NO: 236713 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctccggtaacttgggcagtacc

SEQ ID NO: 236714 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttcgtcggtaacttgggcagttac

SEQ ID NO: 236715 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttcgtcggatacttgggcagttac

SEQ ID NO: 236716 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttcgtcgatacttggagcagttac

SEQ ID NO: 236717 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttcatcgataacttgggcagttac

SEQ ID NO: 236718 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
tatgggctttaagcactgtcgtacgtacgtggcagttacc

SEQ ID NO: 236719 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcactctcggtaacttgggcagttaccc

SEQ ID NO: 236720 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacctcatcggtaacttgggcagttac

SEQ ID NO: 236721 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaacgcacttctcgggtaacttaggcagtac

SEQ ID NO: 236722 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaaagcactttctgggatacctggctagtac

SEQ ID NO: 236723 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaaagcactttctcgggtacttggcagttac

SEQ ID NO: 236724 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaaagcactttctcgggatacttggcagtaa

SEQ ID NO: 236725 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaaagcactttctcgggatacctggcagtac

SEQ ID NO: 236726 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttctaagcacttctcggtaacttgggcggttac

SEQ ID NO: 236727 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttactagcacttctcggtaacttgggcagttac

SEQ ID NO: 236728 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttaaagcactttctgggataccgttggcagtac

SEQ ID NO: 236729 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctcttaagcactcctcggtaacttgggcagttac

SEQ ID NO: 236730 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctctaagcacttcatcagtaacttgggcagttac

SEQ ID NO: 236731 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcgttttaagcacttctcgtaacttgggcagttac

SEQ ID NO: 236732 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcgttttaagcacttctcggtacttgggcagttac

SEQ ID NO: 236733 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcgttttaagcacttctcggtaacttgggcagtta

SEQ ID NO: 236734 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcgttttaagcacttctcggtaacttgggagttac

SEQ ID NO: 236735 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcgttttaagcactctcggtaacttgggcagttac

SEQ ID NO: 236736 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcgttttaagcactctcggtaacttggcgagttac

SEQ ID NO: 236737 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcgtttaagcacttctcggtaacttggccagttac

SEQ ID NO: 236738 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcgtttaagcactctcggtaacttagggcagttac

SEQ ID NO: 236739 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcggttttaagcacttctcggtaacttggcagtta

SEQ ID NO: 236740 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcggttttaagcacttcgcgatacttggcagttac

SEQ ID NO: 236741 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggccttttaagcacttctcggtacttgggcagttac

SEQ ID NO: 236742 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggccttttaagcacttctcggtaactaggcagttac

SEQ ID NO: 236743 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcctttaagcacttcttggtaacttgggcagttac

SEQ ID NO: 236744 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcctttaagcacttctcggtaacttaggcagttac

SEQ ID NO: 236745 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcctttaagcacttcgcgtaacttggccagttacc

SEQ ID NO: 236746 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggccttagcaccttatcggtaacattggcagttaac

SEQ ID NO: 236747 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggccgtttaagcacttctcggtaacttggcagttac

SEQ ID NO: 236748 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcactttaagcacttctcggtaacttgggcagtac

SEQ ID NO: 236749 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcactttaagcacttcggtaacttgggcagcttac

SEQ ID NO: 236750 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggacttttaagcacttctcggtaacttggcagttac

SEQ ID NO: 236751 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggacttttaagcacttctcgggtattgggcagttac

SEQ ID NO: 236752 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggacttttaagcacttctcggaacttgggcagttac

SEQ ID NO: 236753 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggactttagctacttctcggtaacttgggcagttac

SEQ ID NO: 236754 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggactttaagctacttctggtaacttgggcagttac

SEQ ID NO: 236755 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggactttaagcacttcttggtaacttgggcagttac

SEQ ID NO: 236756 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggctttaacgcacttctcggtacctggctcagcctac

SEQ ID NO: 236757 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcttaaagcactttctgggataccgtaggctgatac

SEQ ID NO: 236758 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcgttttaagcacttctcggtaacttgggctagtac

SEQ ID NO: 236759 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcgttttaagcacttccgtgatacttgggcagttac

SEQ ID NO: 236760 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcgtttaagctacttctcggtaacttggcgagttac

SEQ ID NO: 236761 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcgtttaagctacttctcggatacctagtcgagtac

SEQ ID NO: 236762 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcgtttaagcacttctcggttaacttgggcagttac

SEQ ID NO: 236763 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcgtttaagcacttctcggtaacttgggcgagttac

SEQ ID NO: 236764 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcgtttaagcacttctcggtaacttgggcagcttac

SEQ ID NO: 236765 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcgttaaagcactttctgggataccgtggcagtaac

SEQ ID NO: 236766 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcgttaaagcactttctcgggatacctggcagtaac

SEQ ID NO: 236767 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcggttttaagcacttctcggtaacttgggcagtta

SEQ ID NO: 236768 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcgctttaggtcacttctccggtacttggcagttac

SEQ ID NO: 236769 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcgctttaagcacttctcggtaacttgggcagctta

SEQ ID NO: 236770 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggagcttttagcacttctcggtaacttgggcagttac

SEQ ID NO: 236771 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggagcttttaagcacttctcggtaacttggcagttac

SEQ ID NO: 236772 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggagcttttaagcacttccggtaacttgggcagttac

SEQ ID NO: 236773 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgcggctttaagcacttctcggtaacttgggcagttac

SEQ ID NO: 236774 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgcgctttaagcacttctcggtaacttgggcagcttac

SEQ ID NO: 236775 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgaggttttaagcacttctcggtaacttgggcagttac

SEQ ID NO: 236776 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgaggcttttaagcacttctcgtaacttgggcagttac

SEQ ID NO: 236777 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgagcttgtctttaatctcggcagtaggtgctcatggc

SEQ ID NO: 236778 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgacgctttaagcacttctcggtaacttgggcagttac

SEQ ID NO: 236779 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatctgccagtcacatcaactatgatgacgcttgactgga

SEQ ID NO: 236780 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatctcggaccttaaagccgttggtcccacaggattaccg

SEQ ID NO: 236781 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgccagttcacatcaactatgatgacgcttgactgga

SEQ ID NO: 236782 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgccagtcacatcaactactgatgacgcttgactgga

SEQ ID NO: 236783 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgccagccacatcaactattgatgacgcttgactgga

SEQ ID NO: 236784 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcaattttcaagcactatcttgaacagaatgcgtttac

SEQ ID NO: 236785 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataggcctgtcctttaatctcggcagagtgctcatgagc

SEQ ID NO: 236786 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcttgtcttttaatctcggcagagtgctcatgagc

SEQ ID NO: 236787 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagctgtctttctaatctcggcagagtgctcatgagc

SEQ ID NO: 236788 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttagtctcggcagagtgctcatgagc

SEQ ID NO: 236789 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcggagtgcacatgagc

SEQ ID NO: 236790 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggccagatgctcatgagc

SEQ ID NO: 236791 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagagttcgcatgagc

SEQ ID NO: 236792 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagagtgctcatgaga

SEQ ID NO: 236793 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcgcagagtgctcatgagcc

SEQ ID NO: 236794 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaactctcgcagagtgctcatgagc

SEQ ID NO: 236795 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtctttgaatctcggcagagtgctcatgagc

SEQ ID NO: 236796 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtctttaatctcggtacgagtgctcatgagc

SEQ ID NO: 236797 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtctttaatctcggcagagtgctcattgagc

SEQ ID NO: 236798 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtctttaatctcggcagagtgctacatgagc

SEQ ID NO: 236799 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcctttaatctcggcagagtgctcatgagc

SEQ ID NO: 236800 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgccttttaatctcggcaaagtgctcatgagc

SEQ ID NO: 236801 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataacgcctgtctttaatctcggcagagtgctcatgagc

SEQ ID NO: 236802 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcggtccgtactttcaggcgctatcctgatcacccga

SEQ ID NO: 236803 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgctagtcacatcaactatgatgacgcttgactgga

SEQ ID NO: 236804 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgatccgtactttcaggcgttatcctgatcacccga

SEQ ID NO: 236805 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgatccgtactttcaggcgctatcctgatcgcccga

SEQ ID NO: 236806 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgatccgtactttcaggcgctatcctgatcacacga

SEQ ID NO: 236807 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgatccgtactttcaggcgctatccctgaccaccga

SEQ ID NO: 236808 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgatccgtacttcaggtcgccatcctgatcacccga

SEQ ID NO: 236809 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgacccgtactttcaggcgctatcctgatcacccga

SEQ ID NO: 236810 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagggtatccatgaaggactaccttcttactggaggcttg

SEQ ID NO: 236811 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagggtacgatgaagagacccaatcgcccctctgtgcgca

SEQ ID NO: 236812 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taggggcttttaagcacttctcggtagcttgggcagttac

SEQ ID NO: 236813 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taggggctttaagcacttctcggtaaccttgggcagttac

SEQ ID NO: 236814 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagggcgttttagacacttctcggtaacttgggcagttac

SEQ ID NO: 236815 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagggcgttttaagcacttctcggtaactagggcagttac

SEQ ID NO: 236816 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taggcggttttaagcacttctcggtaacttggacagttac

SEQ ID NO: 236817 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taggcggttttaagcacttcccggtaacttgggcagttac

SEQ ID NO: 236818 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taggcctcgatcctcgcaccgcacacgatcccaatgtctg

SEQ ID NO: 236819 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagcttacccatcgagctgagtctacgtctccatcaacgg

SEQ ID NO: 236820 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagcgggcttttaagcacttctcggtaactgggcagttac

SEQ ID NO: 236821 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagcgggctttaagcacttctcggtaacttgggcagttac

SEQ ID NO: 236822 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagcggctttaagcacttctcggttaacttgggcagttac

SEQ ID NO: 236823 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagcggctttaagcacttctcggtaacttgggcagcttac

SEQ ID NO: 236824 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagcacagctcacttcgtctttgatcgaccacgctcataa

SEQ ID NO: 236825 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactcgccagtcacatcaactatgatgaggcttgactgga

SEQ ID NO: 236826 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactcgccagtcacatcaaccatgatgacgcttgactgga

SEQ ID NO: 236827 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactcactagcctcctgtgttgccgcctcgagacagtttg

SEQ ID NO: 236828 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactcaccagccacatcaactatgatgacgcttgactgga

SEQ ID NO: 236829 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttgtccgtcctcttgtggtattgcgcgtgc

SEQ ID NO: 236830 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttgtccgtcctcttgtggtattgcgcacgc

SEQ ID NO: 236831 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttgtccgtcctcctgtggtattgcgcatga

SEQ ID NO: 236832 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgttgtccgtcctcttgtggtattgcgcatgtc

SEQ ID NO: 236833 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgttgtccgatcctcttgtggtattgcgcatgc

SEQ ID NO: 236834 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgttagatccgtcactcactacgcgtatggatc

SEQ ID NO: 236835 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtagatccgtcactcactacgcgtacggaatc

SEQ ID NO: 236836 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgcttgtccgtcctctcgtggtattgcgcatgc

SEQ ID NO: 236837 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactactcgcatcgagcgttgtcaagctgagtgcaagtta

SEQ ID NO: 236838 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactacccccgtcgagcgagtctactctcccatcaacggg

SEQ ID NO: 236839 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactacccccaccgagcgagtctactctcccatcaacggg

SEQ ID NO: 236840 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacgtcgcagcactatctccgttttaagaccgcaagttca

SEQ ID NO: 236841 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacggggcttttaagcacttctggcaacttgggcagttac

SEQ ID NO: 236842 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacggggctttgagcacttctcggtaacttgggcagttac

SEQ ID NO: 236843 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacgggcttttaagcacttctcggtaacttgggcagttat

SEQ ID NO: 236844 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacgggcttttaagcacttctcggtaacttgggcagctac

SEQ ID NO: 236845 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacgggctttaagcacttctcggtaacttgggcagttacc

SEQ ID NO: 236846 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
tacggaggccctcgtgttggactaccaacttgtagaacgg

SEQ ID NO: 236847 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacctgtagtcgtcccgtgcgtgtgggtcgaaatgccgct

SEQ ID NO: 236848 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgtctcatcatcggacacgacgtgtatcagttggctg

SEQ ID NO: 236849 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgtctcatcatcagacacgacgtgtatcagttggctg

SEQ ID NO: 236850 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgggagtccctcctcgtcttgatgcactatcatctca

SEQ ID NO: 236851 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccggcactggaggcgtccttggtggactaccacctttt

SEQ ID NO: 236852 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccggcactggaggcgtccctggtggactaccacctcat

SEQ ID NO: 236853 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccggaagtccctcctcgtcttgatgcgctatcatctca

SEQ ID NO: 236854 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccggaagtccctccccgtcttgatgcgctatcatctca

SEQ ID NO: 236855 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccggaagcccctcctcgtcttgatgcactatcatctca

SEQ ID NO: 236856 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcggggcttagtactagactttgcgcatgacgt

SEQ ID NO: 236857 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcattcatcggacacgacgtgtatcagttgctg

SEQ ID NO: 236858 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggccacgacgtgtatcagttggctg

SEQ ID NO: 236859 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacgcaacgtgtatcagttggctg

SEQ ID NO: 236860 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtaatcagttgctg

SEQ ID NO: 236861 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcaacggacacgacgtgtatcagttggctg

SEQ ID NO: 236862 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgacactggaggcgtccttggtggactaccaccttgt

SEQ ID NO: 236863 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacccgtcttctcgaatcgtcgatctggctcgcctcccta

SEQ ID NO: 236864 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacccgccagtcacatcaactatgatgacgcttgactgga

SEQ ID NO: 236865 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacatggcaagatccgccttggtcctctaccacccgggtg

SEQ ID NO: 236866 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacagtggccctcgtgttggactaccaacttgtagagcgg

SEQ ID NO: 236867 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacagaggtcctcgtgttggactaccaacttgtagaacgg

SEQ ID NO: 236868 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacagaggccctcgttttggactaccaacttgtagaacgg

SEQ ID NO: 236869 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacagaggccctcgtgttggactacctacttgtagaacgg

SEQ ID NO: 236870 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacagaggccctcgcgttggactaccaacttgtagagcgg

SEQ ID NO: 236871 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacagaggcccctcgtgttggactacaacttgtagaacgg

SEQ ID NO: 236872 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacagagccctcgtgttggactaccaacgttgtagagcgg

SEQ ID NO: 236873 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taatggggctttaagcacttctcggtaacttggcagttac

SEQ ID NO: 236874 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taatgggctttaagtcacttctcggtaacttggcagttac

SEQ ID NO: 236875 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taatgggctttaagcacttcgtcggtaacttggcagttac

SEQ ID NO: 236876 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taatgcttggtctcctgtcgactctgcggctgagactact

SEQ ID NO: 236877 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taatccggtacttatcatgcgctatcatgacggctaggac

SEQ ID NO: 236878 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taacttgcgtgcttaggtacccggtcactcctgcacgggt

SEQ ID NO: 236879 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taacttatataggtttgcgcctgtgttcttcctgtggccg

SEQ ID NO: 236880 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaccggggcccgcctcgagctagctacctccattgtctg

SEQ ID NO: 236881 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaccggggcccgcctcaagctagcttcctccattgtctg

SEQ ID NO: 236882 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaccggggcccgcctcaagctagctacctccactgtctg

SEQ ID NO: 236883 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaatctggtcctccttcggtcttagctgctgggaccacc

SEQ ID NO: 236884 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttgtttcctcgtcattcacggactaccgcgataaatggc

SEQ ID NO: 236885 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggttcgaaccggtatgcgta

SEQ ID NO: 236886 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggctcgaaccggcatgcatg

SEQ ID NO: 236887 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcccctgtcctcatggttcgaaccggtatgcatg

SEQ ID NO: 236888 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttaatcccagcgacttcggtggtgtcctctccattacca

SEQ ID NO: 236889 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgtccttatccgcgtctaccgctcgtcttgccacgtctg

SEQ ID NO: 236890 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtggtttcttctcctgactacatgaggttaataaacgcgc

SEQ ID NO: 236891 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtggtccatgagcttctggcatctatccagttgacgctca

SEQ ID NO: 236892 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtggtccatgagcttctggcactatccagttgacgcctca

SEQ ID NO: 236893 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtggaaattctacggcctccgggttgcaacatttcccgtt

SEQ ID NO: 236894 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgatacttaccacctgacatcgcggaagactaatcggtt

SEQ ID NO: 236895 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgagaagcgtgtgagaggctactctgtttgtaacgcaat

SEQ ID NO: 236896 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgaagtcgaaccgcctcgatcctcttcgtctacgtcctc

SEQ ID NO: 236897 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcttatccggcaggacgtctttcgtgcgctatcacgatt

SEQ ID NO: 236898 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtgcttaccaccctgacatcgcggggaactaatggtt

SEQ ID NO: 236899 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtgacttaccacctgacatcgcggggaactaatggtt

SEQ ID NO: 236900 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccactctgacatcgcggggaactaatggtt

SEQ ID NO: 236901 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccacctgacatcgcgggggaattaatggtt

SEQ ID NO: 236902 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccacctgacatcgcggggaactaatcggtt

SEQ ID NO: 236903 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccacctgacatcgcggggaacctaatggtt

SEQ ID NO: 236904 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccacctgacatcgcggggaaactaatggtt

SEQ ID NO: 236905 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccacccttgacatcgcgggaactaatggtt

SEQ ID NO: 236906 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgatatcgcggggaactaatggtt

SEQ ID NO: 236907 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacatcgtggggaactaatggtt

SEQ ID NO: 236908 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacatcgcggggagctaatggct

SEQ ID NO: 236909 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacatcgcggggaatatagtcgt

SEQ ID NO: 236910 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacatcgcggggaactaatagtt

SEQ ID NO: 236911 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacatcgcggggaactaacggtt

SEQ ID NO: 236912 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacatcgcgggaatctaatggtt

SEQ ID NO: 236913 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacatcgcgggaacttaatggtt

SEQ ID NO: 236914 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacaacgcggggaactaatggtt

SEQ ID NO: 236915 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccccgacatcgcggggaactaatggtt

SEQ ID NO: 236916 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttacaccctgacatcgcggggaactaagtggtt

SEQ ID NO: 236917 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacctaccacctgacatcgcgggggaactaatggtt

SEQ ID NO: 236918 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcggtacttaccacctgacatcgcggggaactaatggtt

SEQ ID NO: 236919 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgcattaccaccctgacatcgcgggggaactaatggtt

SEQ ID NO: 236920 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgcacttaccaccctgacatcgcggggaactgatggtt

SEQ ID NO: 236921 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgatgacgcctcgatcctcgcataatatgatacgtctg

SEQ ID NO: 236922 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgagcattgggtcggtttggtggggactaccccttgta

SEQ ID NO: 236923 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgaatcgcctcgatctcgatataatatgatacgtctga

SEQ ID NO: 236924 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgtcgtcccgttttaggtgttacgttgaatctcgttc

SEQ ID NO: 236925 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgggacgcctcgatcctcgcataatatgatacggctg

SEQ ID NO: 236926 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgggacgcctcgatcctcgcataatacgatacgtctg

SEQ ID NO: 236927 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggagcgcctcgatcctcgcataatataatacgtctg

SEQ ID NO: 236928 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggagcgccccgatcctcgcataatatgatacgtctg

SEQ ID NO: 236929 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaatgccttgatcctcgcataatatgatacgtctg

SEQ ID NO: 236930 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcggatcctcgcatatatgatacgtctg

SEQ ID NO: 236931 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgccatatatgatacgtctg

SEQ ID NO: 236932 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgctacgtctg

SEQ ID NO: 236933 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgagtcctcgcatatatgatacgtctg

SEQ ID NO: 236934 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgccacgatcctcgcacaatatgatacgtctg

SEQ ID NO: 236935 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaagcgcttcgatcctcgcataatatgatacgtctg

SEQ ID NO: 236936 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccctggtacgcctcgattccgcccatacatgcatgtaa

SEQ ID NO: 236937 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatgtacgcctcgatttccgcccatacatgcatgtaa

SEQ ID NO: 236938 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcggttccgccatacatgcatggtaa

SEQ ID NO: 236939 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattcgcccatacgatgcatgtaa

SEQ ID NO: 236940 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgctcatacgtgcatgtaa

SEQ ID NO: 236941 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcctatacatgcatgtat

SEQ ID NO: 236942 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccgaacatgcatgtaa

SEQ ID NO: 236943 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatgcatgcatgtag

SEQ ID NO: 236944 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatgcaagtaa

SEQ ID NO: 236945 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatgaatgtaa

SEQ ID NO: 236946 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacaagcatgtaa

SEQ ID NO: 236947 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccataatgacatgtaa

SEQ ID NO: 236948 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccaaacatacatgtaa

SEQ ID NO: 236949 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgccatatcatgcatgtaa

SEQ ID NO: 236950 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgatccctcccgtacatgcatgtaa

SEQ ID NO: 236951 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgactccgcccatacatgcagttac

SEQ ID NO: 236952 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgaatccgcccatacatgcatgtaa

SEQ ID NO: 236953 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgccccgatcccgcccatacatgcatgtaa

SEQ ID NO: 236954 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacacctcgattccgcccgtacatgcatgtaa

SEQ ID NO: 236955 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggcacgcctcgatcccgcccatacatgcatgtaa

SEQ ID NO: 236956 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatccgcttgtccgtcctcttgtggtattgcgcatgc

SEQ ID NO: 236957 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccaagacgattgtcgttattgccggactacctgcattt

SEQ ID NO: 236958 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcatgggctttagctcacttctcgtacttgggcagttac

SEQ ID NO: 236959 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcatgggctttagctcacttctcgtacttggacagttac

SEQ ID NO: 236960 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcatgggctttaagcgacttctcgtaacttggcagttac

SEQ ID NO: 236961 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcatctagcattttactagactactcgtaatacacacaa

SEQ ID NO: 236962 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcactataccgctgcgtgtccgtcatctctcgttgctgt

SEQ ID NO: 236963 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcaccgctggtcgaggagtcgttgtgcgctatcacatct

SEQ ID NO: 236964 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatttctgtgcgcacgccccgcctcgatcaccaataaag

SEQ ID NO: 236965 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatggggcttttaagcacttctcgtacttgggcagttac

SEQ ID NO: 236966 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatgggcttttaagcacttcggtaacttgggtcagttac

SEQ ID NO: 236967 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatgggcttttaagcactctcggtaacttgggcagttac

SEQ ID NO: 236968 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatgggctttaagcacttctcgtaacttgggtcagttac

SEQ ID NO: 236969 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatgggctttaagcacttctcggtaacttgggtagttac

SEQ ID NO: 236970 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatgggctttaagcacttctcggtaacttggacagttac

SEQ ID NO: 236971 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatgggcgttttaagcactctcggtaacctggcgagtac

SEQ ID NO: 236972 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatcgccagtcacatcaactatgatgacgcttgactgga

SEQ ID NO: 236973 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatccctgatgatccgaattctcatcggctggcactatc

SEQ ID NO: 236974 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
gtagcgctgacgcgtcttcgctctcaagaccgtgcatgga

SEQ ID NO: 236975 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtacatggtacgcctcgattccgcccatacatgcatgtaa

SEQ ID NO: 236976 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaataaccttccgttactcgcctcaggcaagtgtgcgca

SEQ ID NO: 236977 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattcacgttgagtcgccttgctcctcttagtctg

SEQ ID NO: 236978 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattcacgttgaatcgccttactcctcttagtctg

SEQ ID NO: 236979 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattcacgttaaatcgcctcgctcctcttagtctg

SEQ ID NO: 236980 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatatcacgttgaatcgcctttgctcctcttagtctg

SEQ ID NO: 236981 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtgatccttcccccgcctcgaagatttgtgcactatatc

SEQ ID NO: 236982 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtgatcctccccccgcctcgaagatttgtgcacatatcc

SEQ ID NO: 236983 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtgatcctcccccccgccttgaagatctgtgcacatatc

SEQ ID NO: 236984 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtgatccctccccccgcctcgaagatttgtgcgcatatc

SEQ ID NO: 236985 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtcttcattgactacaatgatcacgacaaacaatcgagc

SEQ ID NO: 236986 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtccggtatgcgtgcgtttttcttgtgccaccaggatga

SEQ ID NO: 236987 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtatgggctttaagcacttctcggtaacttggcagttac

SEQ ID NO: 236988 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gggtatctgatatgctgttatatttttgggaacctctctt

SEQ ID NO: 236989 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gggtatctgatatgctgttatatttttcggaacctctctt

SEQ ID NO: 236990 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcggccgactcgcctcgatgctccacgcaacgttacgaa

SEQ ID NO: 236991 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcctcgattcctcaggtctcgtgatccgtgcaattgcat

SEQ ID NO: 236992 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggccgtaacccctctctaggcgcctctattggattcacgt

SEQ ID NO: 236993 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcccgttgttggttgatttgcgcgtactagtgccatcga

SEQ ID NO: 236994 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcccgttgtgggttgatttgcgcgtaccagtgccatcga

SEQ ID NO: 236995 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcacgcggaaagtcacacgagctatcgtgacgctggctt

SEQ ID NO: 236996 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggagaatttcgtaggctactactgattacatctttccaca

SEQ ID NO: 236997 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctggtaggctacctgctctatgtcgtggggagtaacagt

SEQ ID NO: 236998 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctggagttccacgcacgcggattgtacccgaactgggtt

SEQ ID NO: 236999 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctgaccttcgtctagcggcgctctgtggtaagattctat

SEQ ID NO: 237000 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctgaccattcgtctagtgagtcaccttagttcatcaagc

SEQ ID NO: 237001 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctcttatccggcaggactctttcgtgcactatcacgatt

SEQ ID NO: 237002 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctattgtgcgcttatggagccgggtaccttccagcaagg

SEQ ID NO: 237003 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctagggcttttacgcacgcggattgtaccgaactgggtt

SEQ ID NO: 237004 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggcttttcacgcacgcggattgtaccgaactgggtt

SEQ ID NO: 237005 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggcttttaagcacttctcggtaacttgggcagttac

SEQ ID NO: 237006 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcgcgcacgcggattgtacccgaactgggtc

SEQ ID NO: 237007 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgctcgcggattgtacccgaactgggtt

SEQ ID NO: 237008 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcccgcggattgtacccgaactgggtt

SEQ ID NO: 237009 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcatgcggattgtacccgaactgggtt

SEQ ID NO: 237010 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgtggattgtacccgaactgggtt

SEQ ID NO: 237011 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcgtattgtacccgaactgggtt

SEQ ID NO: 237012 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcgggattgtaccgaactgggtt

SEQ ID NO: 237013 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcgggactgtaccgaactgggtc

SEQ ID NO: 237014 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtaccggactagggtt

SEQ ID NO: 237015 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtaccgaactagggtt

SEQ ID NO: 237016 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtacccgatctgggtt

SEQ ID NO: 237017 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtacccgaactgggat

SEQ ID NO: 237018 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtaaccgaactgggtt

SEQ ID NO: 237019 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattatacccgaactgggtt

SEQ ID NO: 237020 - skipped

SEQ ID NO: 237021 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggatagtacccgaactgggtt

SEQ ID NO: 237022 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggactatacccgaactgggtt

SEQ ID NO: 237023 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggaatgtacccgaactgggtt

SEQ ID NO: 237024 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcaccgcacgcgggatgtaccgaactgggtt

SEQ ID NO: 237025 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggcttccgcgcacgcggattgtacccgaactgggtt

SEQ ID NO: 237026 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggcttccacgcacgcggactgtacccgaactgggtt

SEQ ID NO: 237027 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggcttcacgcacgcggattgtacccgaactcgggtt

SEQ ID NO: 237028 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggcattcacgcacgcggattgtacccgaactgggtt

SEQ ID NO: 237029 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctagcttcgacgcacgcggattgtacccgaactcgggtt

SEQ ID NO: 237030 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccttcgtctagcggtgctctgtgataagattctact

SEQ ID NO: 237031 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccttcgtccagctaatcgtctgatctgcgacgaggg

SEQ ID NO: 237032 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccatcgtctagtgagtcacccttagttcatcgaggc

SEQ ID NO: 237033 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccatcgtctagtgagccacccttagttcatcaaggc

SEQ ID NO: 237034 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttttcttctcctgactacatgagattaataaacgcgc

SEQ ID NO: 237035 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttgcttctcctgactacatgagattaataaacacgc

SEQ ID NO: 237036 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttcttctcgtgactacatgagaattaataaacgcgc

SEQ ID NO: 237037 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttcttctcctgactacatgagattaataaactgcgc

SEQ ID NO: 237038 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttcttctcctgactacatgagattaataaacgcgtc

SEQ ID NO: 237039 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttcttctcctgactacatgagattaataaacgacgc

SEQ ID NO: 237040 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttcttctcctgactacatgagattaactaaacgcgc

SEQ ID NO: 237041 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttcttctcctgactacatgagaattaataaacgcgc

SEQ ID NO: 237042 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttcgttctcctgactacatgagattaataaacgcgc

SEQ ID NO: 237043 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttcgtctcctgactacatgagattaataaacgcgtc

SEQ ID NO: 237044 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttgtcttctcctgactacatgagattaataaacgcgc

SEQ ID NO: 237045 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttcttctccttgactcacatgagattaataaacgcgc

SEQ ID NO: 237046 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttcttctccttgactacatgagattaataaactgcgc

SEQ ID NO: 237047 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttcttctcctgactacatgagtattaataaactgcgc

SEQ ID NO: 237048 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtccatgacgcttctggcatctatccagttgacgctca

SEQ ID NO: 237049 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtaggcttcacgcacgcggattgtacccgaactgggtt

SEQ ID NO: 237050 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtagctttcacgcacgcggattgtacccgaactgggtt

SEQ ID NO: 237051 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttttttctcctgactacatgagattaataaacgcgc

SEQ ID NO: 237052 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttttctctcctgactacatgagattaataaacgcgc

SEQ ID NO: 237053 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcttgactacatgagattaataaacgcgc

SEQ ID NO: 237054 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctctcgactacatgagattaataaacgcgc

SEQ ID NO: 237055 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgtctacatgagattaataaacgcgc

SEQ ID NO: 237056 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattattaaacgcgc

SEQ ID NO: 237057 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattaatggacgcgc

SEQ ID NO: 237058 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattaatcaacgcgc

SEQ ID NO: 237059 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattaataaccgcgc

SEQ ID NO: 237060 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacataagattaatgaacgcgc

SEQ ID NO: 237061 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacataagatcaataaacgcgc

SEQ ID NO: 237062 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacaggagattaataaacgcgc

SEQ ID NO: 237063 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgacaacatgagattaataaacgcgc

SEQ ID NO: 237064 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcccgactacatgagattaataaatgcgc

SEQ ID NO: 237065 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttcccctgactacatgggattaataaacgcgc

SEQ ID NO: 237066 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttctgatatgctgttatattttttgaacctctctt

SEQ ID NO: 237067 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttctcttcctgactacatgagattagtaaacgcgc

SEQ ID NO: 237068 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttctctcctgactacatgagattaataaactgcgc

SEQ ID NO: 237069 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttctctcctgactacatgagattaataaacgcgtc

SEQ ID NO: 237070 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttctctcctgactacatgagattaataaaccgcgc

SEQ ID NO: 237071 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcatctcctgactacatgagattaataaacgcgc

SEQ ID NO: 237072 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttcttctccttgactacacgagagttaataacgcgc

SEQ ID NO: 237073 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttcttctcctgactacattgagattaataaacgcgc

SEQ ID NO: 237074 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttcttctcctgactacatgagattaataaactgcgc

SEQ ID NO: 237075 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttcttctcctgactacatgagattaataaaccgcgc

SEQ ID NO: 237076 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttcttctcctgactacatgagagttaataaacgcgc

SEQ ID NO: 237077 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttcttctccctgactacatgagattaataaacgcgc

SEQ ID NO: 237078 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttctcttctctgactacatgagattaataaacgcgc

SEQ ID NO: 237079 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttctctccttgactcacatgagattaataaacgcgc

SEQ ID NO: 237080 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttatcttcctctgactactgagattaataaacgcgc

SEQ ID NO: 237081 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttaagacaaatcgagcgggatagttgaattgtaatt

SEQ ID NO: 237082 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtctcttctcctgactacatgagattaatgaacgcgc

SEQ ID NO: 237083 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgggttcttctcctgactacatgagattaataaacgcgc

SEQ ID NO: 237084 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgggatacttgaggtcgttgagcgcttacgaaccctaat

SEQ ID NO: 237085 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggcttcttctcctgactacatgagatcaataaacgcgc

SEQ ID NO: 237086 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgctttcttctcctgactacatgagattaataaacgcgc

SEQ ID NO: 237087 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgctatcctgatttctatcgtcgactatggcgtgcgtgg

SEQ ID NO: 237088 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgcgaactgctgttttggcgctatccaaattttaggcta

SEQ ID NO: 237089 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgccggccttgatcctcaacccgcagtgcactaacgaca

SEQ ID NO: 237090 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgatgtcttctcctgactacatgagattaataaacgcgc

SEQ ID NO: 237091 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgtacagccccgacttatcatctcatggacaccgtgta

SEQ ID NO: 237092 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttggtgggggactacctccttgta

SEQ ID NO: 237093 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttggtgggggactaccctcttgta

SEQ ID NO: 237094 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttggtgggggactacccccctgta

SEQ ID NO: 237095 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttggcgggggactacccccttgta

SEQ ID NO: 237096 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttgatgggggactacccccttgta

SEQ ID NO: 237097 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggtttggtggggacttaccccccttgta

SEQ ID NO: 237098 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcgggtttggtgggggactacccccttgta

SEQ ID NO: 237099 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccggaacgcctcgatcctcgcacaatatgatacgtctg

SEQ ID NO: 237100 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgctgccttcattcgtctgatgatgtgcaccttgagc

SEQ ID NO: 237101 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgcctccgaagccctcctaagtgcactttaagccgcg

SEQ ID NO: 237102 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
gcatgattcatctttgcttgactacacgcaattccgatga

SEQ ID NO: 237103 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcatcctcatgacggtctgctgatggctacatcattgttc

SEQ ID NO: 237104 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcagttcttctccttgactacatgagattaataaacgcgc

SEQ ID NO: 237105 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcactatccgtttgtcgtcctctcgtggtattgcgcatgc

SEQ ID NO: 237106 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcaaggctttcacgcacgcggattgtacccgaactgggtt

SEQ ID NO: 237107 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcaagattcatctttgcttgactacacgcaattccgatgg

SEQ ID NO: 237108 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gattccgttgaccgattacgctcatattaggtaaatccag

SEQ ID NO: 237109 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatggggctttaagcacttctcggtaacttgggcagttac

SEQ ID NO: 237110 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatggggcttctaagcacttctggtaacttgggcagttac

SEQ ID NO: 237111 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatgggcttttaagcacttcttggtaacttgggcagttac

SEQ ID NO: 237112 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatgggcttctaagcacttctcggtaacttgggcagttac

SEQ ID NO: 237113 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatgaggcctttaagctacttctcggtacttggcagttac

SEQ ID NO: 237114 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatctactcatcaggcgctatcctgagcaccgatagtacg

SEQ ID NO: 237115 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcggagacttctccgttggtctgcaggtgtcaccacga

SEQ ID NO: 237116 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcagcttgccttgtttatggcctttagtacaaactgca

SEQ ID NO: 237117 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggcctttatacacacgca

SEQ ID NO: 237118 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggcctctatacaaacgca

SEQ ID NO: 237119 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgcccattgtttaaggcctttatacaaacgca

SEQ ID NO: 237120 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcaccgctgcctttgtttaaggcctttatacaaacgca

SEQ ID NO: 237121 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gataagcctgtcttttaatctcggcagagtgctcatgagc

SEQ ID NO: 237122 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaggtttcttctcctgactacatgagattaataaacgcgc

SEQ ID NO: 237123 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaggactcctctctcacggcctttagtggctgacactatt

SEQ ID NO: 237124 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatgatcataggttcgtcggactaccgacgattttact

SEQ ID NO: 237125 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctggcgtactacttggataggttccttc

SEQ ID NO: 237126 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactatccgtttgtccgtcctttcgtggtattgcgcatgc

SEQ ID NO: 237127 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactatccgtttgtccgtcctcttgtggtattgcgcatac

SEQ ID NO: 237128 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactacccgtatcgagctagtcttgtgctactggcaatca

SEQ ID NO: 237129 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactacccccatcgagcggtttaccgtttggcgacaacgc

SEQ ID NO: 237130 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gacggtttcttctcctgactacatgagattataaacgcgc

SEQ ID NO: 237131 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gacggttccttctcctgactacatgagattaataacgcgc

SEQ ID NO: 237132 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gacggtgtccttctctgactacatgagattaataacgcgc

SEQ ID NO: 237133 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gacggcgagaacgacacttgactacacgtgtacaagttct

SEQ ID NO: 237134 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaccatggtgcgcctcgattccgcccatacatgcatgtaa

SEQ ID NO: 237135 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaccactcgccatcgagctagctcgctctgttcagaacaa

SEQ ID NO: 237136 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaccacccgacatcgagcggtcgatcattcgcatctcttg

SEQ ID NO: 237137 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaatcagtactgacggccgccttgatcctccgtcagtctg

SEQ ID NO: 237138 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggggcccgcctcaagctagctacctccattgtctg

SEQ ID NO: 237139 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggatctcgcctccatactacgtggactttagattt

SEQ ID NO: 237140 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggatcctcgcctccatactgcgtggatttagattt

SEQ ID NO: 237141 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggatcctcgcctccatactacgtggattcagattt

SEQ ID NO: 237142 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggatcctcgcctccatactacgtggatctagattt

SEQ ID NO: 237143 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggatcctcgcctccatactacgtgaatttagattt

SEQ ID NO: 237144 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggatcctcgcctccatactacgcggatttagattt

SEQ ID NO: 237145 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggatcctcgcctccatactaccgtggattagattt

SEQ ID NO: 237146 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccgggtgccgcctcaatctagcctacctcattgtctg

SEQ ID NO: 237147 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccggggcccgcctcaagctagctaccttcattgtctg

SEQ ID NO: 237148 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccggggcccgcctcaagctagctacctccgttgtctg

SEQ ID NO: 237149 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaatctcggatctggcgtactacttggacaggttccttc

SEQ ID NO: 237150 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctttttctcggatgccctgccactagccgcctcgttttct

SEQ ID NO: 237151 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttttatccggcaggacgtccttcgtgcactatcacgatt

SEQ ID NO: 237152 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctttctcggatcttcaacatattgccgcctcgcatccgac

SEQ ID NO: 237153 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttgtccaggactacctggtcagttcaagctagatctgtg

SEQ ID NO: 237154 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttctacgtccgaggacgtctttcgtgcactatcacgatt

SEQ ID NO: 237155 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttcctcggatcttcaacatattgccgcctcgcatccgaa

SEQ ID NO: 237156 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttagtaatttcgccgcccctctgtttagtggccattgaa

SEQ ID NO: 237157 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttaattccagcgacttcggtggtgtcctctccattacca

SEQ ID NO: 237158 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgtctcggatcaatttacgcctcagttttccctactatg

SEQ ID NO: 237159 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgtcatatatctcacctgcctcgttccttctaatcgctg

SEQ ID NO: 237160 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgtagtgattcctgaaggctcctagtggctgggactagc

SEQ ID NO: 237161 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctggccgacatgcatgattgtcctgggagtcccacaatgt

SEQ ID NO: 237162 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcttatccggcaggacgttttcgtgcactatcacgatt

SEQ ID NO: 237163 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcgctccctgtcattcgggcgctatcccgataacacga

SEQ ID NO: 237164 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcgcaccctgtcattcgggcgctatcccgataatacga

SEQ ID NO: 237165 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcgaactagtggtctttgtgcgcttaagacccgtcgat

SEQ ID NO: 237166 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcctctgctctccctctcggatcgcgcacgtggatatg

SEQ ID NO: 237167 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcctcggtcgacccctaatgttgcaacataatggtaaa

SEQ ID NO: 237168 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcaccccgatagtcgtcttcgctggaccacccgtgtta

SEQ ID NO: 237169 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgatagcaatctgtggtattcatagcgatagtaatgcaa

SEQ ID NO: 237170 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgagctttcacgcacgcggattgtacccgaacgtgggtt

SEQ ID NO: 237171 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttgtccggcaggacgtctttcgtgcactatcacgtat

SEQ ID NO: 237172 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatcctgcaggacgtctttcgtgcactatcacgatt

SEQ ID NO: 237173 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcggacgtctttcgtgcactatcacgatt

SEQ ID NO: 237174 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcaggacgtctttcgtgcacatcacgatt

SEQ ID NO: 237175 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcaggacgtcttcgtgcgactatcacgat

SEQ ID NO: 237176 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcagacgtccttctgcgactatcacgatt

SEQ ID NO: 237177 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcagacgcctttcgtgcgactatcacgat

SEQ ID NO: 237178 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcgggacgtctttcgtgcactatcacggtt

SEQ ID NO: 237179 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcgggacgcctttcgtgcactatcacgatt

SEQ ID NO: 237180 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcgagcagtctttcgtgcactatcacgatt

SEQ ID NO: 237181 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcagtacgtctttcgtgcactatcacgatt

SEQ ID NO: 237182 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggtcgtctttcgtgcactatcacgatt

SEQ ID NO: 237183 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcagggcgtttttcgtgcactatcacgatt

SEQ ID NO: 237184 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcagggcgtctttcgtgcactatcgcgact

SEQ ID NO: 237185 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcagggcgactttcgtgcactatcacgatt

SEQ ID NO: 237186 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggctgtctttcgtgcactatcacgatt

SEQ ID NO: 237187 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggatgtctttcgagcactatcacgatt

SEQ ID NO: 237188 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggatcgtctttcgtgcactatcacgat

SEQ ID NO: 237189 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggactctttcgtgcactatcacgtatt

SEQ ID NO: 237190 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgttcactatcacgatt

SEQ ID NO: 237191 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgtactatcacgatt

SEQ ID NO: 237192 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcgccatcacgatt

SEQ ID NO: 237193 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactatcccgatt

SEQ ID NO: 237194 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactatcacgagt

SEQ ID NO: 237195 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactatcacgaat

SEQ ID NO: 237196 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactataacggtt

SEQ ID NO: 237197 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactataacgatt

SEQ ID NO: 237198 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactaccacgtat

SEQ ID NO: 237199 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcacaatcacgatt

SEQ ID NO: 237200 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcctgcactatcacgatt

SEQ ID NO: 237201 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtcttcgtgcactatcacgagtc

SEQ ID NO: 237202 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtcttcggtgcactatcacgatt

SEQ ID NO: 237203 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtcttccgtgcgctatcacgatt

SEQ ID NO: 237204 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtcctttcgtgcactatcacgat

SEQ ID NO: 237205 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtccttcgtgcgctatcacgatt

SEQ ID NO: 237206 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtccttcgtgcactatcacggtt

SEQ ID NO: 237207 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgcctttcgtgcactatcgcgatt

SEQ ID NO: 237208 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgactttcgtgcactatcacgtat

SEQ ID NO: 237209 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggaccgtcttcgtgcactatcacgatt

SEQ ID NO: 237210 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacatctttcgtgcactataacgatt

SEQ ID NO: 237211 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcagacgtctttcgtgcactatcgacgatt

SEQ ID NO: 237212 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcagaccgtctttcgtgcgactatcacgat

SEQ ID NO: 237213 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaaggacgtctttcgtgcactatcacgat

SEQ ID NO: 237214 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaagacgtctttcgtgcactatcacaatt

SEQ ID NO: 237215 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccagcagggcgtctttcgtgcactatcacgatt

SEQ ID NO: 237216 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccagcaggacgtctttcgtgctctatcacgatt

SEQ ID NO: 237217 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccagcaggacgtctttcgtgcgctatcacgatt

SEQ ID NO: 237218 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatacggcaggacgtctttcgtgcactatcacgatt

SEQ ID NO: 237219 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttaaccggcaggacgtctttcgtgcactatcacgatc

SEQ ID NO: 237220 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctcggatcatttgcctcgctcctcctagagttggatgg

SEQ ID NO: 237221 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctcatccggcaggacgtctttcgcgcactatcacgatt

SEQ ID NO: 237222 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctcatccggcaggacatctttcgtgcactatcacgatt

SEQ ID NO: 237223 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctcatccggcagaacgtctttcgtgcactatcacgatt

SEQ ID NO: 237224 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctcatccagcaggacgtctttcgtgcactatcacgatt

SEQ ID NO: 237225 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctatccggcaggacgtctttcgtgcacctatcacgatt

SEQ ID NO: 237226 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctatccgcatcgagcgggttcttcgataatatgcaaca

SEQ ID NO: 237227 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctatccgcaggacgatctttcgtgcactatcacgagtt

SEQ ID NO: 237228 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctaatccgagatcgtcttgacgctgcactatcacgaat

SEQ ID NO: 237229 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctaacccggcaggacgtctttcgtgcactatcacgatt

SEQ ID NO: 237230 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
ctcgcgaacgccttagtcacccttctcggataacatgatt

SEQ ID NO: 237231 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcctattcggcaggacgtctttcgtgcactatcacgatt

SEQ ID NO: 237232 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccatcgtgcaagtcatttacgcagactactgcgacgct

SEQ ID NO: 237233 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccaccgtgcaagtcgtttacgcagactactgcgacgct

SEQ ID NO: 237234 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccaccgtgcaagtcatttacgcagactactgcgaggct

SEQ ID NO: 237235 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccaagacgattgtcgttattgccggactacctgcatta

SEQ ID NO: 237236 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcatatccggcaggatgtctttcgtgcactatcacgatt

SEQ ID NO: 237237 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcatatccggcaggacgtccttcgtgcactatcacgatt

SEQ ID NO: 237238 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctatccctgatgatccgaattctcatcggctggcactatc

SEQ ID NO: 237239 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctagttgtgcgcttatggagccgggtaccttccagcaagg

SEQ ID NO: 237240 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctagctttcacgcacgcggattgtacccgtaactcgggtt

SEQ ID NO: 237241 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctactccggatgagccacctcgcattcctccgttcgtcag

SEQ ID NO: 237242 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctactccggatgagccacctcgaattcctccgttcgtctg

SEQ ID NO: 237243 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctacgaattagtggtctttgtgcgcttaagacccgtcgat

SEQ ID NO: 237244 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctacgaactagcggtctttgtgcgtttaagacccgtcggt

SEQ ID NO: 237245 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgtttacatgtacccctaccatcgcacctgttagcatatg

SEQ ID NO: 237246 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgtgatagactactaccttatgtgccgttcatattccaat

SEQ ID NO: 237247 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgtgactaattggcggactaccgcctcgatattagatcat

SEQ ID NO: 237248 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgtctatccgcatcgagcgggtcttcgataatatgcaaca

SEQ ID NO: 237249 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgtcaccccgatagtcaatcttcgctggacacccgcgtta

SEQ ID NO: 237250 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggttcttctccttcgactacatgagattaataaacgcgc

SEQ ID NO: 237251 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggttcactctctgactacatgagattaactaaaccgcgc

SEQ ID NO: 237252 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgggggtgattcttggatcgcgttctcctcaccttctccg

SEQ ID NO: 237253 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgggggcttttaagcacttctcggtaacttgggcagttac

SEQ ID NO: 237254 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggctaacgttcatcgagggagcaaagggtctatagacta

SEQ ID NO: 237255 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggctaacgttcatcgagggagcaaaaggtctatagacga

SEQ ID NO: 237256 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggctaacgttcatcgagggagcaaaaggtctatagacca

SEQ ID NO: 237257 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggctaacgttcatcgagcgagcaaaaggtctatagacta

SEQ ID NO: 237258 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggaccccactgttaacagttcctccctcaggtgtgtcaa

SEQ ID NO: 237259 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcttcacaccaccctctgcagatacgtgtacataaggac

SEQ ID NO: 237260 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcttatccgttgtccgtcctcttgtggtattgcgcatgc

SEQ ID NO: 237261 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctattcgtatcgagcggtcggtctgtgccctaaaccca

SEQ ID NO: 237262 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgagcgagtactttgtgcgatcacaca

SEQ ID NO: 237263 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgagcgagcactttgtgcgatcccaca

SEQ ID NO: 237264 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgagcgagcactttgtgcgatcacgca

SEQ ID NO: 237265 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtcggtcctcttgtggtattgcgcatgc

SEQ ID NO: 237266 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctcttgtggtattacgcatgc

SEQ ID NO: 237267 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctcttgtgggattgcgcatgc

SEQ ID NO: 237268 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctcttgcggtattgcgcatgc

SEQ ID NO: 237269 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctctcgtggtactgcgcatgc

SEQ ID NO: 237270 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctctcgtggcattgcgcatgc

SEQ ID NO: 237271 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtccccttgtggtattgcgcatgc

SEQ ID NO: 237272 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgcccgtcctcttgtggtattgcgcatgc

SEQ ID NO: 237273 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtccatcgagcgaacagtgtgcgtcttcggtg

SEQ ID NO: 237274 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtccatcgagcgaacagtgtgccgtttcggtg

SEQ ID NO: 237275 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtatcgaggagtcttcttctctcactagaggc

SEQ ID NO: 237276 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtaatcgagtcttgagtgtctgttaacaacga

SEQ ID NO: 237277 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtaatcgagcttgagtgtctggttaacaacga

SEQ ID NO: 237278 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcttgtccgtcctctcgtggtattgcgcatgc

SEQ ID NO: 237279 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcttgcccgtcctcttgtggtattgcgcatgc

SEQ ID NO: 237280 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcgtcgagcgggttcttcgataatatgcaaca

SEQ ID NO: 237281 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgtacagtgtgccgttttcggtg

SEQ ID NO: 237282 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgaactgtgtgccgttttcggtg

SEQ ID NO: 237283 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgaacagtgtgctgttttcggtg

SEQ ID NO: 237284 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgaacacgtgtgccgtttcggtg

SEQ ID NO: 237285 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggttctttgataatatgcaaca

SEQ ID NO: 237286 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggttcttcgatgatgtgcaacg

SEQ ID NO: 237287 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggttcttcgatagtatgcaaca

SEQ ID NO: 237288 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggttcttcgataatatgcaata

SEQ ID NO: 237289 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggttcttcgataacgtgcaaca

SEQ ID NO: 237290 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggtacttctataatatgcaaca

SEQ ID NO: 237291 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggctcttcgataatatgcaaca

SEQ ID NO: 237292 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgcgttcttcgataatatgcaaca

SEQ ID NO: 237293 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgagttcttcgataatatgcaaca

SEQ ID NO: 237294 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcagtcgagtcgggttctcgacatatgcagca

SEQ ID NO: 237295 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtgtcttgttaaacaacga

SEQ ID NO: 237296 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtgtctggctaaacaatga

SEQ ID NO: 237297 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagctagagtgtctggttaaacaacga

SEQ ID NO: 237298 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcgttgtcaacaagcggctaaggcc

SEQ ID NO: 237299 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcgtgagtgtctggttaaacaacga

SEQ ID NO: 237300 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgttacttcccggcattgccgcaatcgccatacatata

SEQ ID NO: 237301 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgtctccctggcattgccgcgattgccatacattaata

SEQ ID NO: 237302 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgctatctcggtcctgctgtgctgcctcagttcctcca

SEQ ID NO: 237303 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgcagcctcggtcctgctcagcatggccatgccgttat

SEQ ID NO: 237304 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgcacgatagggttgtcttgtggcactatccacattta

SEQ ID NO: 237305 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgaaacgctattttctgggaaaccgcatctcgagcgaa

SEQ ID NO: 237306 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccttgcttgtcccgacgcatgctatgatcgcttgtctg

SEQ ID NO: 237307 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccttgatcctcgctttcggtgcactgacccgctttctg

SEQ ID NO: 237308 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcctcgctcctttagctgggttccggataccagctaata

SEQ ID NO: 237309 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcctcgcaattggtaagctcatcaacactctcgttgcta

SEQ ID NO: 237310 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcctcgaaattctctgtatatgcatatatcagtctaggc

SEQ ID NO: 237311 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcctcgaaattccctatatatgcatatatcagcctaggc

SEQ ID NO: 237312 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccggaggtccctcctcgtcttgatgcactatcatctca

SEQ ID NO: 237313 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccggaagtccctcctcgtcttgatgcgctatcatctca

SEQ ID NO: 237314 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccggaagtccctcctcgtcttgatgcaccatcatctca

SEQ ID NO: 237315 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccggaagtcccccctcgtcttgatgcactatcatctca

SEQ ID NO: 237316 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccggaagtcccacctcgtcttgatgcactatcatctca

SEQ ID NO: 237317 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccatccgtttgtccgtcctcttgtggtattgcgcatgc

SEQ ID NO: 237318 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcaatccgccatcgagcgaacagtgtgccgttttcggtg

SEQ ID NO: 237319 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgatgggcttttaagcacttctcggtaacttggcagttac

SEQ ID NO: 237320 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgatatatgtagtcggtttgcctcggtcgtccttgcactg

SEQ ID NO: 237321 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgagtgtcactcggatcgcgttgatcatccagtcgcacgt

SEQ ID NO: 237322 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgagcccgggaacgctgcctcgattcaggggacgtatata

SEQ ID NO: 237323 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgagaacctcggatcacattcgcctttcctctaccgtctg

SEQ ID NO: 237324 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgactatccgtttgtccgtcctctcgtggtatgcgcatgc

SEQ ID NO: 237325 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgactatccgtttgtccgtcccttgtggtattgcgcatgc

SEQ ID NO: 237326 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgacgtttcatcccgcgtttcgcgccatgaacccccgctg

SEQ ID NO: 237327 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccttccagggccaatgcccgcattatcatcctatgttctg

SEQ ID NO: 237328 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctgggcttcctactatttcaacgttgaaaactgtctgta

SEQ ID NO: 237329 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctgctattagccactatgctatctcatacagtgccgtac

SEQ ID NO: 237330 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcttatccgcaggacgtctttcgtgcactatcacgatt

SEQ ID NO: 237331 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctctacgtccgaggacgtctttcgtgcactatcacgatt

SEQ ID NO: 237332 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgtatcttccggtgattaccacgtacgtacatgtctg

SEQ ID NO: 237333 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgtatcttccggtaattgccacgtacgtacatgtctg

SEQ ID NO: 237334 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgtaccttccggtaattaccacgtacgtacatgtctg

SEQ ID NO: 237335 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcggaccttctgctagctgatgacatgtcattcgttta

SEQ ID NO: 237336 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcagcttgtcgtgctttgtccgctatgacattca

SEQ ID NO: 237337 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcagctagtcgtgctttgtccgctatggcattca

SEQ ID NO: 237338 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcagctagtcgtgctttgtccgctacgacattca

SEQ ID NO: 237339 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcagctagtcgcgctttgtccgctatgacattca

SEQ ID NO: 237340 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcaactagtcgtgctttgtccgctatgacattca

SEQ ID NO: 237341 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtctccactcctagaggaaagtactttacctgcgtctg

SEQ ID NO: 237342 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtcacctcgactatcatcttcactgtaacaaccgtgta

SEQ ID NO: 237343 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtcaccctgatagtcatcttcactggacacccgtgtta

SEQ ID NO: 237344 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtcacccgatagtcatcttcactggaccacccgtgtta

SEQ ID NO: 237345 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtcacccgatagtcatcttcactggaacaacccgtgta

SEQ ID NO: 237346 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtcaccccgatagtcatcttcactggaacacccgtgta

SEQ ID NO: 237347 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgggtctctattgtcgtctttgtaggactacctgcatca

SEQ ID NO: 237348 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgggtcattattgtcgtctttgtaggactacctgcatca

SEQ ID NO: 237349 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgggcctttattgtcgtctttgtaggactacctgcatca

SEQ ID NO: 237350 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccggaattctccatcccattctcggatgtgatcactcatt

SEQ ID NO: 237351 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgctcggatcgttcccaatggtggtaccccctattaatg

SEQ ID NO: 237352 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcggccgtctagattctccctgtagctgcatcgcataa

SEQ ID NO: 237353 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcgccttcgccgatgcgcacggaaatacacttggctta

SEQ ID NO: 237354 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttgtttccctccggaccttgtacaagatggtgttg

SEQ ID NO: 237355 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttggtcctgtagcgctagaccaacttccggacaca

SEQ ID NO: 237356 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttggatcctctacagcctaccaccatggatgttaa

SEQ ID NO: 237357 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttgcctgttcacgtggccactgaacacttttctga

SEQ ID NO: 237358 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
ccgccttgactccaaccccggggtatgtaccataattgcg

SEQ ID NO: 237359 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttcagtcctggtggtaccacaacgcattgcccttt

SEQ ID NO: 237360 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttcaggttcctctaacgcgttagccttccggaatg

SEQ ID NO: 237361 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttcaggttccctaacgcgttacgccttccggaatg

SEQ ID NO: 237362 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttcagattctcctaacgcgttagccttccggaatg

SEQ ID NO: 237363 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcggtaccgttccaacgcgttagccttccggaatg

SEQ ID NO: 237364 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcggatcgttcccaacggtggtacccctattaatg

SEQ ID NO: 237365 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgcgtcgctgtacacgaagacctccggagatttg

SEQ ID NO: 237366 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgagtcccaaattcgacaagaacacccggtggaa

SEQ ID NO: 237367 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaattgcacaccttcctccgaacttagccatgg

SEQ ID NO: 237368 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgtgggaccttcgattgctag

SEQ ID NO: 237369 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgacgtggaaccttcgattgctag

SEQ ID NO: 237370 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctccttcctccatgagcatgcttactcgggatacta

SEQ ID NO: 237371 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctccaggttccctaacgcgttacgccttccggaatg

SEQ ID NO: 237372 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcagtccgtggatccactttgcacgcgccatgaca

SEQ ID NO: 237373 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggtttccctaacgcgttagccttccggaagtg

SEQ ID NO: 237374 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttccctaactcgcgttagccttccggaatg

SEQ ID NO: 237375 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttccctaaccgcgttagccttccggaatcg

SEQ ID NO: 237376 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttccctaaccgcgttagccctccggaactg

SEQ ID NO: 237377 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttccccttaacgcgttagccttccggaatg

SEQ ID NO: 237378 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgttagccttccggaatga

SEQ ID NO: 237379 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgattagctttccggaatg

SEQ ID NO: 237380 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttccccataacgcgttagccttccggaatg

SEQ ID NO: 237381 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcacctcaccacaacagctgcgtggttatgtctcc

SEQ ID NO: 237382 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctatgtctctcaccgagcatgctcgcgtcaggtttg

SEQ ID NO: 237383 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccgttcaggttccctaacgcgttagccttccgggatg

SEQ ID NO: 237384 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccacccgagtagtcatcttcactggacacccgtgtta

SEQ ID NO: 237385 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcatcctgatagtcatcttcgctggaccacccgcgtta

SEQ ID NO: 237386 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcagcccgatagtcatcttcgctggaccactcgcgtta

SEQ ID NO: 237387 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcactccgatagtcatcttcactggaccacccgtgtta

SEQ ID NO: 237388 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccctgatagtcatcttcgctggaccacctgcgtta

SEQ ID NO: 237389 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccctgatagtcatcttcactggaccacctgtgtta

SEQ ID NO: 237390 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccctgactagtcatcttcactggacacccgtgtta

SEQ ID NO: 237391 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccctcgatagtcatcttcactggacacccgtgtta

SEQ ID NO: 237392 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccgatagtcatctttcgctggaccacccgcgtta

SEQ ID NO: 237393 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccgatagtcatcttcactggaccacccgtgttac

SEQ ID NO: 237394 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccgatagtcatcttcactggaccacccgtcgtta

SEQ ID NO: 237395 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccctgatagtcgtcttcgctggaccaccgtgtta

SEQ ID NO: 237396 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccctgatagtcatcttcactggacacccgtgttg

SEQ ID NO: 237397 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccctgatagtcatcttcaccggaccacctgtgta

SEQ ID NO: 237398 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccctgatagtcatctccgctggaccaccgcgtta

SEQ ID NO: 237399 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccggatagtcatcttcactggacacccgtgtta

SEQ ID NO: 237400 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgctagtcatcttcactggaccacccgtgtta

SEQ ID NO: 237401 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgattagtcatcttcattggacacccgtgtta

SEQ ID NO: 237402 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgattagtcatcttcaatggacacccgtgtta

SEQ ID NO: 237403 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatggtcatcttcgctggaccacccgcgtta

SEQ ID NO: 237404 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatcactcatcttcactggaccaccgtgtta

SEQ ID NO: 237405 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcgtcttcgctggaccacccgtgtca

SEQ ID NO: 237406 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcgtcttccgctggacacccgtgtta

SEQ ID NO: 237407 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatctttgctggaccacccgcgtta

SEQ ID NO: 237408 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatctttactggaccacccgtgtta

SEQ ID NO: 237409 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcgttggaccacccgcgtta

SEQ ID NO: 237410 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcgctgggccacccgcgtta

SEQ ID NO: 237411 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcgctggatcacccgcgtta

SEQ ID NO: 237412 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcgctggactacccgcgtta

SEQ ID NO: 237413 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcgctggaccgcccgcgtta

SEQ ID NO: 237414 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcgctggaccactcgcgtta

SEQ ID NO: 237415 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcgctggaccacctgcgtta

SEQ ID NO: 237416 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcgctggaccacccgtgcta

SEQ ID NO: 237417 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcgctggaccacccgcgttg

SEQ ID NO: 237418 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcgctggaccacccgcgcta

SEQ ID NO: 237419 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcgctggaccacccgcatta

SEQ ID NO: 237420 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcgatggaccacccgcgtta

SEQ ID NO: 237421 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcattggaccacccgtgtta

SEQ ID NO: 237422 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcagctggacacccgtgtta

SEQ ID NO: 237423 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcacttgaccacccgtgtta

SEQ ID NO: 237424 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggaccgcccgtgtta

SEQ ID NO: 237425 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggaccatccgtgtta

SEQ ID NO: 237426 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggaccactcgtgtta

SEQ ID NO: 237427 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggaccacccgtgtaa

SEQ ID NO: 237428 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggaccacccgtggta

SEQ ID NO: 237429 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggaccacccgtatta

SEQ ID NO: 237430 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggacacccgtgttaa

SEQ ID NO: 237431 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggacaccacgtgtta

SEQ ID NO: 237432 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggaacacccgtgtta

SEQ ID NO: 237433 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactagaccacccgtgtta

SEQ ID NO: 237434 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcctcgctggaccacccgcgtta

SEQ ID NO: 237435 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcattcactggacacccgtgtta

SEQ ID NO: 237436 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagctcaccctcactggacacccgtgtta

SEQ ID NO: 237437 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagccatctttactggaccacccgtgtta

SEQ ID NO: 237438 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgacttagtcatcttcactggacacccgtgta

SEQ ID NO: 237439 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgactagtcatcttcgctggacacccgcgtta

SEQ ID NO: 237440 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgacagtcatcttcgctggaccacccgcgtta

SEQ ID NO: 237441 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgacagtcatcttcgctggaccaccccgcgta

SEQ ID NO: 237442 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgattagtcatcttcactggacaccgtgtta

SEQ ID NO: 237443 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtcatcttcgctggaccacccgcgtt

SEQ ID NO: 237444 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtcatcttcactgggcacccgtgtta

SEQ ID NO: 237445 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccaatagtcatcttcgctggaccacccgtgtta

SEQ ID NO: 237446 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccaatagtcatcttcgctggaccacccgcgtta

SEQ ID NO: 237447 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaacccgatagtcgtcttcgctggaccacccgtgtta

SEQ ID NO: 237448 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgagcaccctgatagtcatcttcactggacaccgtgtta

SEQ ID NO: 237449 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgacacccgattagtcatcttcactggacacccgtgtta

SEQ ID NO: 237450 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgacacccgatagtcatccttcactggacacccgtgtta

SEQ ID NO: 237451 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccttatccggcaggacgtctttcgtgcgctatcacgatt

SEQ ID NO: 237452 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccctcttcgtcaccacgtcgggactaccccgaaagaagtg

SEQ ID NO: 237453 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccctcttcgtcacacgtcggggactaccccgcaagaagtg

SEQ ID NO: 237454 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccctctatagtcgttggcgtagcacgctattgcttagaag

SEQ ID NO: 237455 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccctctatagtcgtcggcgtagcacgctattgcttaaaag

SEQ ID NO: 237456 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccctctatagtcgtcggcgtagaacgctattgcttagaag

SEQ ID NO: 237457 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccctatccgtttgtccgtcctcttgtggtattgcgcatgc

SEQ ID NO: 237458 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccctacgattgttctcccgttacgtcactccctagtgccg

SEQ ID NO: 237459 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccggcgtctcccaaaatgcgcattgatcgatcccgtttg

SEQ ID NO: 237460 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgcctcaggttcccctaacgcgttagccttccggaatg

SEQ ID NO: 237461 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgcacctcgatagtcatcttcactggacacccgtgtta

SEQ ID NO: 237462 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccctgaaacgtccacatgggctgcaaccggcattgcgcg

SEQ ID NO: 237463 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccccgattcctcctagcatgctacagtggcgatcatgacg

SEQ ID NO: 237464 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccaaagacttcaggcgctatcctgatctagtctaacatg

SEQ ID NO: 237465 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgttcgcttatggtagccgggtaccttccagcaagg

SEQ ID NO: 237466 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtgctgcttgtggagccgggtaccttccagcaagg

SEQ ID NO: 237467 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtgcgcttatggagtccgggtaccttccagcaagg

SEQ ID NO: 237468 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtgcgcttatggaggccgggtaccttccagcaagg

SEQ ID NO: 237469 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtgcgcttatggagccgggtaccttccaagcaagg

SEQ ID NO: 237470 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtgcgcttatggagccggggtaccttccagcaagg

SEQ ID NO: 237471 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtgcgcttatggaagccgggtaccttccagcaagg

SEQ ID NO: 237472 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtgccgcttatggagccgggtaccttccagcaagg

SEQ ID NO: 237473 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattctagatagttctctaatccttcgcgtggtgtgata

SEQ ID NO: 237474 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccagctagcggggcgttcattggcctagaaattttcttat

SEQ ID NO: 237475 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccactatcgttgtccgtctcttgtcggtattgcgtcatgc

SEQ ID NO: 237476 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccactaaaggtgcctagtccccgtgtcgcctcccagtcta

SEQ ID NO: 237477 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccacaccccgatagtcatcttcgctggaccacccgcgtta

SEQ ID NO: 237478 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catttgccagtcacatcagctatgatgacgcttgactgga

SEQ ID NO: 237479 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattgcgctgcttatggagccgggtaccgttccagcaagg

SEQ ID NO: 237480 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattgaaatttctggcgctatccagttgtatatttcagga

SEQ ID NO: 237481 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattccggaaaccgcctctatccctgtttggtggccgcta

SEQ ID NO: 237482 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catggggcttttaagcacttctcggtaactgggcagttac

SEQ ID NO: 237483 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catggggctttaagcacttctcggtaacttgggcggttac

SEQ ID NO: 237484 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catgggcttttaagcacttctcggtaacttgggcagttgc

SEQ ID NO: 237485 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catgggcttttaagcacttctcggtaacttggcgagttac

SEQ ID NO: 237486 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
catgggctttaagctacttctcggtaacttggcgagttac

SEQ ID NO: 237487 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catgctgcctcggttcgcgaatcgctcccttctcactgcg

SEQ ID NO: 237488 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catgcgaccggtacatgcttagcctcgcagtatgattaat

SEQ ID NO: 237489 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catgactcccctgcagctctcggatgtccgttcttcccgt

SEQ ID NO: 237490 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catgaccggtattggcaggtctttcgggcgtatcccgatg

SEQ ID NO: 237491 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctctcggctgccgtgcgcacgcagctgactcgaactg

SEQ ID NO: 237492 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctattcgttgtccgtcctcttgtggtattgcgcatgc

SEQ ID NO: 237493 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctatccgtttgtccgtcctctcgtgtattgcgcatgc

SEQ ID NO: 237494 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctatccgcttgtccgtcctcttgtggattgcgcatgc

SEQ ID NO: 237495 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catcggagtctgcctatcatgcgcaatcatgttgtcagga

SEQ ID NO: 237496 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catcggaagtccctcctcgtcttgatgcactatcatctca

SEQ ID NO: 237497 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catcgatacatccaaacgagccttcgcggctggcgctatc

SEQ ID NO: 237498 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catcccggtggctcgtgttcagcaacgctccttaacacga

SEQ ID NO: 237499 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cataagcttgtcttttaatctcggcagagtgctcatgagc

SEQ ID NO: 237500 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagtcaatgttcatcgagcgagttatattgttgcataacg

SEQ ID NO: 237501 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagcttatccgttgtccgtcctcttgtgtattgcgcatgc

SEQ ID NO: 237502 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagcttaccgttgtcgtcctcctgtagtagttgcgcatgc

SEQ ID NO: 237503 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagctatccgttgtccgtcctcttgtggtactgcgcatgc

SEQ ID NO: 237504 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagctaacgctcatcgagacgggatcgtcgaagtgttttg

SEQ ID NO: 237505 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacttatccgtttgtccgtcctcttgtgtattgcgcatgc

SEQ ID NO: 237506 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacttatccgttgtccgtcctcctgtgtattgcgcatgtc

SEQ ID NO: 237507 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacttatccgttgtccgtcctcctgtggtattgcgcatgc

SEQ ID NO: 237508 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacttatccgctgtccgtcctcttgtggtattgcgcatgc

SEQ ID NO: 237509 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactgtccgtttgtccgtcctcttgtggtattgcgcatcc

SEQ ID NO: 237510 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactgtccgtttgtccgtcctcttgaggtattgcgcatgc

SEQ ID NO: 237511 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactgtccgttgtccgtcctctcgtcggtattgcgcatgc

SEQ ID NO: 237512 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactggaagtccctcctcgtcttgatgcactatcatctca

SEQ ID NO: 237513 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactattcgtttgtccgtcctcttgtggtattgcgcatac

SEQ ID NO: 237514 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactattcgtttgtccgtcctcttgtggtattgcgcacgc

SEQ ID NO: 237515 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactattcgcttgtccgtcctcttgtggtgttgcgcatgc

SEQ ID NO: 237516 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatctgtttgtccgtcctcttgtggtattgcgcgtgc

SEQ ID NO: 237517 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatctgtttgcccgtcctcttgtggtattgcgcatgc

SEQ ID NO: 237518 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatctgtctgtccgtcctcttgtggtattgcgcatgc

SEQ ID NO: 237519 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatctgtcatcgagcgagcactttgtgcaatcacaca

SEQ ID NO: 237520 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatctgcttgtccgtcctcttgtggtattgcgcatgc

SEQ ID NO: 237521 - skipped

SEQ ID NO: 237522 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcgttgtcccgtctcttgtggtattgcgcatcgcg

SEQ ID NO: 237523 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcgtgttgtccgtcctcttgtggtattgcgcatgc

SEQ ID NO: 237524 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttttccgtcctcttgtggtattgcgcatgc

SEQ ID NO: 237525 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttttccgtcctctcgtggtattgcgcatgc

SEQ ID NO: 237526 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttttgtccgtcctctgtggtattgcgcatgc

SEQ ID NO: 237527 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtctgtcctcttatggtattgcgcatgc

SEQ ID NO: 237528 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtctgtcctcctgtggtattgcgcatgc

SEQ ID NO: 237529 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtctgtcctcctgaggtattgcgcatgc

SEQ ID NO: 237530 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtcggtcctcttgtggtattgcgcatgc

SEQ ID NO: 237531 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtcggtcctctcgtggtattgcgcatgc

SEQ ID NO: 237532 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgttctcttgtggtattgcgcacgc

SEQ ID NO: 237533 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgttctctcgcggtattgcgcatgc

SEQ ID NO: 237534 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgttctcctgtggtattgcgcatgc

SEQ ID NO: 237535 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgttcctctgtggtattgcgcatgc

SEQ ID NO: 237536 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcttcttgtggtgttgcgcatgc

SEQ ID NO: 237537 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcttcttgtggtattgcgcacgc

SEQ ID NO: 237538 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcttctggtggtattgcgcatgc

SEQ ID NO: 237539 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcttcctgtggtattgcgcatgc

SEQ ID NO: 237540 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtctcttgtgtgatatgcgcatcg

SEQ ID NO: 237541 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtctccttgtggtattgcgcatgc

SEQ ID NO: 237542 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccttcttgtcgtatgcgcatag

SEQ ID NO: 237543 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccttctgtggtattgcgcgtgc

SEQ ID NO: 237544 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccttctgtggtattgcgcatgc

SEQ ID NO: 237545 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccttctcgtggtatgcgcatag

SEQ ID NO: 237546 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggttttgcgcatgc

SEQ ID NO: 237547 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtgttgcgcacgc

SEQ ID NO: 237548 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgtgcacgc

SEQ ID NO: 237549 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcgcgc

SEQ ID NO: 237550 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcagac

SEQ ID NO: 237551 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattccgcatgc

SEQ ID NO: 237552 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtatgcgcacgac

SEQ ID NO: 237553 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtactgcgcgtgc

SEQ ID NO: 237554 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtactgcgcacgc

SEQ ID NO: 237555 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggcactgcgcatgc

SEQ ID NO: 237556 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggaattgcgcgtgc

SEQ ID NO: 237557 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtgatactgcgcatgc

SEQ ID NO: 237558 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtagtattgcgcacgc

SEQ ID NO: 237559 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgcggtattgcgtatgc

SEQ ID NO: 237560 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgaggtgttgcgcatgc

SEQ ID NO: 237561 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgaggtattgcgcatac

SEQ ID NO: 237562 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttatggtattgcgcaagc

SEQ ID NO: 237563 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttacggtattgcgcatgc

SEQ ID NO: 237564 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctgtggtattcgcgcatgc

SEQ ID NO: 237565 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctgtggtaattgcgcatgc

SEQ ID NO: 237566 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgttgtattgcgcatgc

SEQ ID NO: 237567 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtgttattgcgcatgc

SEQ ID NO: 237568 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggttttgcgcatgc

SEQ ID NO: 237569 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgcgtaagc

SEQ ID NO: 237570 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgcgcctgc

SEQ ID NO: 237571 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgcgcatcg

SEQ ID NO: 237572 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgcgcacac

SEQ ID NO: 237573 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgagcatgc

SEQ ID NO: 237574 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtatgtcgcatgc

SEQ ID NO: 237575 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtatagcgcatgc

SEQ ID NO: 237576 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtagtgcgcatgc

SEQ ID NO: 237577 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggcgttgcgcatgc

SEQ ID NO: 237578 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtgatatgcgcatcgc

SEQ ID NO: 237579 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtagtattgcgcacgc

SEQ ID NO: 237580 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgcggtgttgcgcatgc

SEQ ID NO: 237581 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcctggtgttgcgcatgc

SEQ ID NO: 237582 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcgcgtggtattgcgcatgc

SEQ ID NO: 237583 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctccttgtggtattgcgcatg

SEQ ID NO: 237584 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtgtatgcgcatgccc

SEQ ID NO: 237585 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggttttgcgcatgc

SEQ ID NO: 237586 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggtgattgcgcatg

SEQ ID NO: 237587 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggtattgcgcaggc

SEQ ID NO: 237588 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggtattgcgcaagc

SEQ ID NO: 237589 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggtattgcccatgc

SEQ ID NO: 237590 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggtattgcacatgc

SEQ ID NO: 237591 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggtatcgcgcatgc

SEQ ID NO: 237592 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggtactgcgcatgc

SEQ ID NO: 237593 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgcggtattgcgcatgc

SEQ ID NO: 237594 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcatgtggtattgcgtatgc

SEQ ID NO: 237595 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcatatggtattgcgcatgc

SEQ ID NO: 237596 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcccttgtcggtattgcgcacgc

SEQ ID NO: 237597 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccctctgtggtattgcgcatgc

SEQ ID NO: 237598 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccctctcgtggtatgcgcatgc

SEQ ID NO: 237599 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcatctcgtggtattgcgcatgc

SEQ ID NO: 237600 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccggcctcctgtggtattgcgcatgc

SEQ ID NO: 237601 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgccttcttatggtattgcgcatgc

SEQ ID NO: 237602 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgccctcttgtggtattgcgcatcg

SEQ ID NO: 237603 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgccctctcgtggtgttgcgcatgc

SEQ ID NO: 237604 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgacctcttgtgggattgcgcatgc

SEQ ID NO: 237605 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtcccgtctcttgtggtattgcgcatgc

SEQ ID NO: 237606 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccatcctcttgtggtattgcgcacgc

SEQ ID NO: 237607 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccatcctcctgtggtattgcgcatgc

SEQ ID NO: 237608 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtcagtcctctcgtggtattgcgcatgc

SEQ ID NO: 237609 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtacgtcctcttgtggtattgcgcatgc

SEQ ID NO: 237610 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttggctcgtcctcttgtggattgcgcatgc

SEQ ID NO: 237611 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgctcgtcctcttgtggtattgcgcatac

SEQ ID NO: 237612 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgctcgtcctctcgtggtattgcgcatgc

SEQ ID NO: 237613 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgcctcgtcctctgtggtattgcgcatgc

SEQ ID NO: 237614 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
cactatccgtttgcccgtcctcttgtggtgttgcgcatgc

SEQ ID NO: 237615 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgcccgtcctcttgcggtattgcgcatgc

SEQ ID NO: 237616 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgatcttgtctctccctctcaggcaaccg

SEQ ID NO: 237617 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgatccgtcccttgtggtattgcgcatgc

SEQ ID NO: 237618 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgactcgtcctctgtggtattgcgcatgc

SEQ ID NO: 237619 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgaccgtcctctcgtggtattgcgcatgc

SEQ ID NO: 237620 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttctccgtcctctcgtggtattgcgcatgc

SEQ ID NO: 237621 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttcgtccgtcctcttgtggtatgcgcatgc

SEQ ID NO: 237622 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttcgtccgtcctctgtggtattgcgcatgc

SEQ ID NO: 237623 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttcgtccgtcctctcgtggtatgcgcatgc

SEQ ID NO: 237624 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttatccgtcctcttgtggtatcgcgcatgc

SEQ ID NO: 237625 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttatccgtcctctcgtggtattgcgcatgc

SEQ ID NO: 237626 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgttccgtcctcttgtgggattgcgcatgc

SEQ ID NO: 237627 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtcgtccttcttgtgtacttgcgcatgtc

SEQ ID NO: 237628 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcttcctgtggtattgcgcatgtc

SEQ ID NO: 237629 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtctcttgtgtaacatgcgcatagc

SEQ ID NO: 237630 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtccttcttgtcgtattgcgcatgc

SEQ ID NO: 237631 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtccttcttatggtattgcgcatgc

SEQ ID NO: 237632 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtccttctcgtggtattgtgcatgc

SEQ ID NO: 237633 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtccttctcgtggtattgcgcatgc

SEQ ID NO: 237634 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtgtatgcgtacatggc

SEQ ID NO: 237635 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtattgcgcattgc

SEQ ID NO: 237636 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtattgcgcatcga

SEQ ID NO: 237637 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtattgcgacatgc

SEQ ID NO: 237638 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtattgccgcatgc

SEQ ID NO: 237639 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggaattgcgcatgtc

SEQ ID NO: 237640 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttcgtggtattgcgcatcg

SEQ ID NO: 237641 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctctcgtggtattgtcgcatgc

SEQ ID NO: 237642 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctctcgtggtattgccgcatgc

SEQ ID NO: 237643 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcgttgtggtattgcgcatgc

SEQ ID NO: 237644 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcctgtcggtattgcgcatgc

SEQ ID NO: 237645 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtccgtcttgtggtattgcgcatgc

SEQ ID NO: 237646 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccggtcctcttgtggtattgcgcatgc

SEQ ID NO: 237647 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgatcctcttgtggtatgcgtcatgc

SEQ ID NO: 237648 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgatcctctcgtggtactgcgcatgc

SEQ ID NO: 237649 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtcccgtcctcttgtggtattgcgcatgc

SEQ ID NO: 237650 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtcccgtccctctgtggtattgcgcatgc

SEQ ID NO: 237651 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgctccgtcctctcgtggtattgcgcatgc

SEQ ID NO: 237652 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgcctcgtcctcttgtggtattgcgcatgc

SEQ ID NO: 237653 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgcctcgtcctctcgtggtattgcgcatgc

SEQ ID NO: 237654 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttctgtccgtcctcttgtggtattgcgctgc

SEQ ID NO: 237655 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttctgtccgtcctcttgtggtattgcgcatg

SEQ ID NO: 237656 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttctgtccgtcctcttgtggtatgcgcatgc

SEQ ID NO: 237657 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttctgtccgtcctctgtggtattgcgcacgc

SEQ ID NO: 237658 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttctccgtcctcttgtggtattgcgcatgtc

SEQ ID NO: 237659 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttcgtcgtcctcttgtcggtattgcgcatgc

SEQ ID NO: 237660 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttcgtccgtcctcttgtggcattgcgcatgc

SEQ ID NO: 237661 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttcgtccgtcctcttgaggtattgcgcatgc

SEQ ID NO: 237662 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttagtccgtcctctcgtggtattgcgcatgc

SEQ ID NO: 237663 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtgtgtccgtcctctcgtggtattgcgcatgc

SEQ ID NO: 237664 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtcttgacgtattcccttcggacatccatcaa

SEQ ID NO: 237665 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtcttaacgtgttcccttcggacatccgtcaa

SEQ ID NO: 237666 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtcttaacgtgttcccttcggacatccctcaa

SEQ ID NO: 237667 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtcctcttgtggtattgcgcttgc

SEQ ID NO: 237668 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtcctcttgtggtattgcacatgc

SEQ ID NO: 237669 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtcctcttgtggtaatgcgcatgc

SEQ ID NO: 237670 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtcctctagtggtattgcgcatgc

SEQ ID NO: 237671 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgccctcttgtggtattgcgcatgc

SEQ ID NO: 237672 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctctcgtccttcttgtggtattgcgcatgc

SEQ ID NO: 237673 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatgtccgtcctctcgtggtattgcgcatgc

SEQ ID NO: 237674 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagtgttgtcaacaagcggctaaggcc

SEQ ID NO: 237675 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcaacaagcggttaaggcc

SEQ ID NO: 237676 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgtggtcaacaagcggctaaggcc

SEQ ID NO: 237677 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcggtcggtccgtgccctaaaccca

SEQ ID NO: 237678 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgatcgtcgtaatactgcttccaa

SEQ ID NO: 237679 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcatctcactacgcgtatgactc

SEQ ID NO: 237680 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcatctcactacgcgtatagaat

SEQ ID NO: 237681 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcactgcgcgtatggaatc

SEQ ID NO: 237682 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcactatgcgtatggaatc

SEQ ID NO: 237683 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcactacgcgtctggaatc

SEQ ID NO: 237684 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcactacgcgcatggaatc

SEQ ID NO: 237685 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcactacgcatatggaatc

SEQ ID NO: 237686 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgccactcactacgcgtatggaatc

SEQ ID NO: 237687 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagacccgtcactcactacgcgtacggaatc

SEQ ID NO: 237688 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccggttgtccgtcctcttatggtattgcgcatgc

SEQ ID NO: 237689 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccggtagatccgtcatctcactacgcgtatgtat

SEQ ID NO: 237690 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgttcgtcctcttgtggtattgcgcatgc

SEQ ID NO: 237691 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgttctcttgtggtattgcgcatgc

SEQ ID NO: 237692 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtggtattgcgtatgc

SEQ ID NO: 237693 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtggtattgcgcgtgc

SEQ ID NO: 237694 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtggtattgcgcatga

SEQ ID NO: 237695 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtggtattgcgcataa

SEQ ID NO: 237696 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtggtattacgcatgc

SEQ ID NO: 237697 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtggtagtgcgcatgc

SEQ ID NO: 237698 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctctcgtggtgttgcgcatgc

SEQ ID NO: 237699 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctctcgtggcattgcgcatgc

SEQ ID NO: 237700 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctctcgcggtattgcgcatgc

SEQ ID NO: 237701 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcctgtggtactgcgcatgc

SEQ ID NO: 237702 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtccccttgtggtattgcgcatgc

SEQ ID NO: 237703 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgccctcttgtggtattgcgcatgc

SEQ ID NO: 237704 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgaccgtttatccgatagttgcgaatccg

SEQ ID NO: 237705 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgaccgtcctcttgtggtattgcgcatgc

SEQ ID NO: 237706 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttatgctcgcctctctctcggttgcgcgtt

SEQ ID NO: 237707 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttacgttcgcctctctctcggttgcgcgtt

SEQ ID NO: 237708 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgctcgtccgtcctcttgtggtgttgcgcatgc

SEQ ID NO: 237709 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcgatcgagcgaatcgcatcataaatcgcgtg

SEQ ID NO: 237710 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcatcgagctttcgtccgggagtgcatagcta

SEQ ID NO: 237711 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcatcgacgcgttagtcttgctgccatgcagc

SEQ ID NO: 237712 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcagatccgtcactcactacgcgtatggaatc

SEQ ID NO: 237713 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcaacagacggctctcagatactgtatctttg

SEQ ID NO: 237714 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgattgtccgtcctctcgtggtattgcgcatgc

SEQ ID NO: 237715 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgacatcgagagagctacgttatcaagcgctaa

SEQ ID NO: 237716 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgacatcgagagagctacgtcatctagcgcaaa

SEQ ID NO: 237717 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgacatcgagagagctacgtcatcaggcgctaa

SEQ ID NO: 237718 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgacatcgagagagatacgtcatcaagcgctaa

SEQ ID NO: 237719 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgacatcgaaagagctacgtcatcaagcgctaa

SEQ ID NO: 237720 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgaaatcgagcgagaactctggtgttgacgcag

SEQ ID NO: 237721 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcccgtttgtccgtcctctgtggtattgcgcatgc

SEQ ID NO: 237722 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcccgttgtccgtcctcttgtggtattgcgcatgc

SEQ ID NO: 237723 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcccgttgtccgtcctctgtggtattgacgcatgc

SEQ ID NO: 237724 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcgagcgtgcggtttctgttacactgtta

SEQ ID NO: 237725 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcgagcgatcgtggtaatactgcttccaa

SEQ ID NO: 237726 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcgagcgatcgtcgtaatactgctaccaa

SEQ ID NO: 237727 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcgagcgatcgtcgtaatacagcttccaa

SEQ ID NO: 237728 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcgagcgatcgtcgtaacactgcttccaa

SEQ ID NO: 237729 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcgagcgatcgtcgtaaaactgcttccaa

SEQ ID NO: 237730 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcgagcgatcgccgtaatactgcttccaa

SEQ ID NO: 237731 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccatttgtccgtcctctcgtggtattgcgcatgc

SEQ ID NO: 237732 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccatttgtccgtcctcctgtggtattgcgcatgc

SEQ ID NO: 237733 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccacttaacccgttctcccagagtttggagtgtt

SEQ ID NO: 237734 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatacgtttgtccgtcctctcgtggtattgcgcatgc

SEQ ID NO: 237735 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactagtccgttgtccgtcctcttgtggtattgcgcatgc

SEQ ID NO: 237736 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactactcgtttgtccgtcctcttgtggtattgcgcatgc

SEQ ID NO: 237737 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactactccgttgtccgtcctctgtggtattgcgcatgtc

SEQ ID NO: 237738 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactacccgtttgtccgtcctcttgtggtattgcgcaggc

SEQ ID NO: 237739 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgttgaatgttatccgccttgcttccgtccctaggctg

SEQ ID NO: 237740 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgttgaatgttatccgccttgcttccgtccctaagccg

SEQ ID NO: 237741 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgtgcttccaatatgcatctcggacattcctccccccg

SEQ ID NO: 237742 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
cacggttatgtctgactttcgggcgctatcccgatttcgt

SEQ ID NO: 237743 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccggaagtccctcctcttcttgatgcactatcatctca

SEQ ID NO: 237744 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccggaagtccctcctcgtcttgatacactatcatctca

SEQ ID NO: 237745 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccggaagtcccccctcgtcttgatgcactatcatctca

SEQ ID NO: 237746 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgtctgtccgtcctcctgtggtattgcgcatgc

SEQ ID NO: 237747 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacattggtttgccgccttgtcactccgacgactgtgcca

SEQ ID NO: 237748 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacagttaaatacaaccgctttgccgcctctgtatgtctg

SEQ ID NO: 237749 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacaatccgtttgtccgtcctctcgtggtattgcgcatgc

SEQ ID NO: 237750 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacaatcaagatcctcctaatacgcctcgtcctggtgtcg

SEQ ID NO: 237751 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacaagcagtgctggtctgcctcggtccttctcgtttgta

SEQ ID NO: 237752 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgcttgatctcctgtcgactctgcggttgagactacc

SEQ ID NO: 237753 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgcttgatctcctgtcgactctgcggctgagaccact

SEQ ID NO: 237754 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgcttgatctcccgtcgactctgcggctgagactact

SEQ ID NO: 237755 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgctcgatctcctgtcgactctgcggctgagactact

SEQ ID NO: 237756 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatatccgtttgtccgtcctcttgtggtattgcgcatgc

SEQ ID NO: 237757 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caagcacaagattcttccttctgcacgtgcagggctccgg

SEQ ID NO: 237758 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caaatcctccggccgcttcgaaatagtatgatagtctgcg

SEQ ID NO: 237759 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attggtccatgagcttctggcactatccagttgacgctca

SEQ ID NO: 237760 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attgattgcttattggtggcacactattgcctgaacttta

SEQ ID NO: 237761 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attgattcctattggtggcacactattgccttgaacttta

SEQ ID NO: 237762 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attctgttttttaggttggcgaggtcctctaacttttggg

SEQ ID NO: 237763 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attctgttttttaagttggcgaggtcctctagcttttggg

SEQ ID NO: 237764 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attctgttttttaagttggcgaggtcctctaacttatggg

SEQ ID NO: 237765 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attctgttctttaagttggcgaggtcctctaacttttggg

SEQ ID NO: 237766 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attctcgtcgccgttcaatcgactacgcttgatcatgcgg

SEQ ID NO: 237767 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attccgtttagagaaatctgttggccactatgccatcagt

SEQ ID NO: 237768 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attccgtttagagaaatctgttggccactatgccaccaat

SEQ ID NO: 237769 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attcaatccagccgacttggtgtcgttcctctccactaca

SEQ ID NO: 237770 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattgcagcgacttcggtggtgtcctctccattacca

SEQ ID NO: 237771 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagtgacttcggtggtgtcctctccattacca

SEQ ID NO: 237772 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttcggtggtgtcttctccattacca

SEQ ID NO: 237773 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttcggtggtgtcctctgcattacca

SEQ ID NO: 237774 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttcggtggtgtcctctccattacaa

SEQ ID NO: 237775 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttcggtggtgtcccctccattacta

SEQ ID NO: 237776 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttcggtggtgccctctccattacca

SEQ ID NO: 237777 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttcggtggcgtcctctccattagca

SEQ ID NO: 237778 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttcggtggcgtcctctccattacca

SEQ ID NO: 237779 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttcgatggtgtcctctccattacca

SEQ ID NO: 237780 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgactccggtggtgtcctctccattacca

SEQ ID NO: 237781 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaatccagcgactttcggtggtgtcctctccattacca

SEQ ID NO: 237782 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtggctttaagcacttctcggtaacttgggcagttacc

SEQ ID NO: 237783 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtgccactgagcttctggcactatccagttgacgctca

SEQ ID NO: 237784 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgagtcttactggcactatccagttgacgctca

SEQ ID NO: 237785 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgagcttctggcatctatccagttgacgctcta

SEQ ID NO: 237786 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgagcttctggcacgtatcccagttgacgctca

SEQ ID NO: 237787 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgacgtctctcggccactatcgattgacgctca

SEQ ID NO: 237788 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgacggctctggcactatccagttgacgctaca

SEQ ID NO: 237789 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgacgcttctggtcactatccagttgacgctca

SEQ ID NO: 237790 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgacgcttctcggcactatccagttgacgctca

SEQ ID NO: 237791 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggttccatgagcttctggtactatccagttgacgctca

SEQ ID NO: 237792 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtggcttttagcacttctcggtaacttgggcagttac

SEQ ID NO: 237793 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtggcttttaagcacttctcggtaacttggcagttac

SEQ ID NO: 237794 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtgcttttaagcacttctcggtaacttggacagttac

SEQ ID NO: 237795 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtgctttagctacttctcgtaacttgggtcaagttac

SEQ ID NO: 237796 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtgctttaagcacttctcggtaacttggacgagttac

SEQ ID NO: 237797 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtcttatgagcttctggcactatccagttgacgctca

SEQ ID NO: 237798 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtcccatgagcttcaggcactatccagttgacgctca

SEQ ID NO: 237799 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagttttctggcactatccagttgacgctca

SEQ ID NO: 237800 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagtcttctgtcactatccagttgacgctca

SEQ ID NO: 237801 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagtcttctggcgctatccagttgacgctca

SEQ ID NO: 237802 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagtcttctggcactatccagttgacgctcg

SEQ ID NO: 237803 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagtcttctggcactatccagtcgacgctca

SEQ ID NO: 237804 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagctttctggcactatccagttgacgctca

SEQ ID NO: 237805 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggtcactatccagttgacgctca

SEQ ID NO: 237806 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactatccgtagtgacgctca

SEQ ID NO: 237807 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactatcccagttgacgctcg

SEQ ID NO: 237808 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactatccagttggacgctca

SEQ ID NO: 237809 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactatccagttcgacgctca

SEQ ID NO: 237810 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcacgtatccagttgacgctca

SEQ ID NO: 237811 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagctctggcatctatcccagttgacgctca

SEQ ID NO: 237812 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagccttctggcactacccagttgacgctca

SEQ ID NO: 237813 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgggtgcttttaagcacttctcggtaacttggcagttac

SEQ ID NO: 237814 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggaggctttagacacttctcggtaacttgggcagttac

SEQ ID NO: 237815 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggaggctttaagcacttctcggtaacttggtcagttac

SEQ ID NO: 237816 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggagcttttaagcacttctcggtaacttgggcagttac

SEQ ID NO: 237817 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggagctttaagctacttctcggtaacttgggcagttac

SEQ ID NO: 237818 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgcgcaactcatcgtgaagagttcccgtattgcatgcaa

SEQ ID NO: 237819 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgcgaacgctattttctgggaagccgcatctcgagcgaa

SEQ ID NO: 237820 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgatgggctttaagcacttctcgtaacttgggcagttac

SEQ ID NO: 237821 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgatgggcttctaagcacttctcgtaacttgggcagtta

SEQ ID NO: 237822 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgatggcttttaagcacttctcggtaacttggcagttac

SEQ ID NO: 237823 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgatctcggatctggcgtactacttggacaggttccttc

SEQ ID NO: 237824 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgatccatgtagcttctggcactatccagttgacgctca

SEQ ID NO: 237825 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgatccatgagcttctggcactatccgagttgacgctca

SEQ ID NO: 237826 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgagtccgcggcttcactagactactactgatcacgtcg

SEQ ID NO: 237827 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgaggctttaagctacttctcggtaacttgggcagttac

SEQ ID NO: 237828 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atctccgttctaacacgtgcactatcacggcttagttaga

SEQ ID NO: 237829 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atctccgtctaactacgtgcactatcacggcttagttggt

SEQ ID NO: 237830 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atctccgtctaacacgtgcactatcacggccttagttaga

SEQ ID NO: 237831 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgtccatctagtcgcgatacagaatacgactaacataa

SEQ ID NO: 237832 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcggtccactgagccttcggcactatcagttgacgctca

SEQ ID NO: 237833 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcggccatgagcttctggccactatccagttgacgctca

SEQ ID NO: 237834 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgatgggcctttagcacttctccgtacttggcagttac

SEQ ID NO: 237835 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcctttgcgctgcgtacggtttgtcttcctcgttcctct

SEQ ID NO: 237836 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgttctcgtataattcaggatggcttattagctagct

SEQ ID NO: 237837 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgttctcgtataattcaggaaggcttattatctagct

SEQ ID NO: 237838 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgtcctcgtataattcaggatggcttattatctagct

SEQ ID NO: 237839 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcggtcctcgcataatatgatacgtctg

SEQ ID NO: 237840 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcgtaatatgatacgtctg

SEQ ID NO: 237841 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcgaaatatgatacgtctg

SEQ ID NO: 237842 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgccatatatgatacgtctg

SEQ ID NO: 237843 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatccccgcataatatgatacgtctg

SEQ ID NO: 237844 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgctctcgtataattcaggatggcttattatctagct

SEQ ID NO: 237845 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgcctcgcttgtgcacaacttgtatcccgcgtctgcg

SEQ ID NO: 237846 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgcctcgcttcgtcgcacaactcgcatcgcgtctgcg

SEQ ID NO: 237847 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgcctcgccttgtgcacaactcacatccgcgtctgcg

SEQ ID NO: 237848 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgcccgtacatgcatgtaa

SEQ ID NO: 237849 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgcccatgcatgcatgtaa

SEQ ID NO: 237850 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgcccatacctgcatgtaa

SEQ ID NO: 237851 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcatgatggagaaatgaatcactatattcttgtacgctc

SEQ ID NO: 237852 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcagttccggcgacttcggtggtgtcctctccattacca

SEQ ID NO: 237853 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcagactgcccgtctacacgctgggctaccaccgtattg

SEQ ID NO: 237854 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcacagcgcccagaatgccccgtttcccgtgttcgggac

SEQ ID NO: 237855 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atatgggcttttaagcacttctcggtaacttggcagttac

SEQ ID NO: 237856 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atatgggctttaagctacttctcggtaacttggcagttac

SEQ ID NO: 237857 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atatccgcagccacatcaactatgatgacgcttgactgga

SEQ ID NO: 237858 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ataggtccttgggtatccgcctcgctaagtttgtgcatgc

SEQ ID NO: 237859 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ataggtcctggggtatccgcctcgctaagtttgtgcgtgc

SEQ ID NO: 237860 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agttttctcggatccaaacgcatatcctcctccgcctcgc

SEQ ID NO: 237861 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agttttctcggatccaaacacatatcctcccccgcctcgt

SEQ ID NO: 237862 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agttctctcggatccaaacgcatatcctcctccgcctcgt

SEQ ID NO: 237863 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtactacgcctcgaggagctctcacctccctctgtccgg

SEQ ID NO: 237864 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agctctttccaggactacctgtgttacaatcgcttcgcca

SEQ ID NO: 237865 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agcgaaacgctattttctgggaagccgcgtctcgagcgaa

SEQ ID NO: 237866 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agcattgttccagccttctcccacagcggctggcactatc

SEQ ID NO: 237867 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agcactatctctggactgaatcgtgcacccgacggttcgc

SEQ ID NO: 237868 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agcactatctccgtgagtctcgtcaactcccgtacgctag

SEQ ID NO: 237869 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agatttctcggatccaaacgcatatcctcctccgcctcgt

SEQ ID NO: 237870 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
agattctagattaaccgcctcggtcagcctagattgtgca

SEQ ID NO: 237871 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agatgggagtacttgttcgactacgatcattgacgtcact

SEQ ID NO: 237872 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agatgggagactttgctcgactacgatcattgacgtcact

SEQ ID NO: 237873 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agaccgggccgccttcaagctacgctacctccattgtctg

SEQ ID NO: 237874 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agaccgggcccgcctcaagctagctacctccaattgtctg

SEQ ID NO: 237875 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agaccggagcccgcctcaagctagctacctccattgtctg

SEQ ID NO: 237876 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actgtaggcacctgctctatgtcgtggggagtaacaggtc

SEQ ID NO: 237877 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actgtaggcacctgctctatatcgtggggagtaacaggtt

SEQ ID NO: 237878 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actgatgcgatttaaccgggtgtgagttcatcgcagtact

SEQ ID NO: 237879 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actaccttcgtctagtggttcaatagcatgaaacttcgtg

SEQ ID NO: 237880 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actaactccagcgacttcggtggtgtcctctccattacca

SEQ ID NO: 237881 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgtttgcttctcctgactacatgagattaataaacgcgc

SEQ ID NO: 237882 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgttcttctccttgactacatgagattaagtaaacgcgc

SEQ ID NO: 237883 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgtgatcagctagtcgtgctttgtccgctatgacattca

SEQ ID NO: 237884 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgtccttatcggctaggcggtcttctgcactatcacgat

SEQ ID NO: 237885 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgtacccgcctcgctccttgcgaccgcatctgctgtcga

SEQ ID NO: 237886 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgtacccgcctcgctccttgcaaccgcatctgctgtcga

SEQ ID NO: 237887 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acggtttcttcttctgactacatgagattaataaacgcgc

SEQ ID NO: 237888 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acggtttcttctcctgactacgtgagattaataaacgcgc

SEQ ID NO: 237889 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acggtttcttctcctgactacatgagattaatagacgcgc

SEQ ID NO: 237890 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acggtttcttctcctgactacatgagattaataaacgcac

SEQ ID NO: 237891 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acggttcttctccttgactacatgagattaataaacgcgc

SEQ ID NO: 237892 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acggtggcttttaagcacttctggtaacttgggcagttac

SEQ ID NO: 237893 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acggtctcttctcctgactacatgagattaataaacgcgc

SEQ ID NO: 237894 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acggtctcttcctctgactacatgagattaataaacgcgc

SEQ ID NO: 237895 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acggcgtctcccgcattgccgcaattgccatacattaata

SEQ ID NO: 237896 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgcctatcgctatcgagcggttcttccgataatagcaca

SEQ ID NO: 237897 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttcctcagcttccgcggcgcaggatttgcacgt

SEQ ID NO: 237898 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgactctccctcagcctccgcggtgcaggatttgcacgt

SEQ ID NO: 237899 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgactattccggaagtcatcgtttaaccgtttgttgcaa

SEQ ID NO: 237900 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgaattctccttgctatggtcctcctggtacttgctgcg

SEQ ID NO: 237901 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accggcctcaggttccctaacgccgttagccttccggatg

SEQ ID NO: 237902 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accggccctcaggttccctaacgcgttagccttcggaatg

SEQ ID NO: 237903 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accggccaccccgatagtcatcttcactggacaccgtgta

SEQ ID NO: 237904 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accggcaccccgatagtcatcttcactggaccaccgtgta

SEQ ID NO: 237905 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accggcaccccgatagtcatcttcactggacaccgtgtta

SEQ ID NO: 237906 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcttgtgtgcgacacagtgtcctacgactcctctcag

SEQ ID NO: 237907 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcatgggtcggttttggtgggggactacccccttgca

SEQ ID NO: 237908 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcatgggtcggttttggtgggggactacccccctgta

SEQ ID NO: 237909 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcatgggtcggtttggttggggacgtaccccttcgta

SEQ ID NO: 237910 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcacgggtcggttttggtgggggactacccccttgta

SEQ ID NO: 237911 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accctatcttgatgtctcttcggggactaccccgattctg

SEQ ID NO: 237912 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accctatcttgacgtctcttcggggactaccccgactctg

SEQ ID NO: 237913 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accctatcttgacgtctcttcgaggactaccccgattctg

SEQ ID NO: 237914 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accctagaataatctgtatgccagactactggcttgattg

SEQ ID NO: 237915 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acccggaacgcctcgatcctcgcataatacgatacgtctg

SEQ ID NO: 237916 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acccgcctccgaagccctcctaagtgcactttaaaccgcg

SEQ ID NO: 237917 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acatctattccggtaagtcatctttaaccgttgttgcaaa

SEQ ID NO: 237918 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acatcctcgtgacggtctgttgatggctacatcattgttc

SEQ ID NO: 237919 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagtgggttccatgctttaggcgcctcttattttgggcc

SEQ ID NO: 237920 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagtaggttccatgctttaggcgcctcttattttgggtc

SEQ ID NO: 237921 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acaggcttgacgcttactctccgatgtagcctggcatgac

SEQ ID NO: 237922 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagctatccggtaagtcatcgtttaaccgtttgttgcaa

SEQ ID NO: 237923 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactgggctctcatgcgcgcgacccatctctcagta

SEQ ID NO: 237924 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactggacttctcagcgcgcgacccatctctcagta

SEQ ID NO: 237925 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactggactctcagcgcgtgacccatctcgtgagta

SEQ ID NO: 237926 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactggactctcagcgcgcgacccatctcgtcatta

SEQ ID NO: 237927 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactggactctcagcgcgcgacccatcccgtcagta

SEQ ID NO: 237928 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acacttattccggtaagtcatcgtttacttcgttgtacaa

SEQ ID NO: 237929 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactgttccggtaagtcatcgtttaaccgtttgtcgcaa

SEQ ID NO: 237930 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggttagtcatcgtttacccgtttgttgcaa

SEQ ID NO: 237931 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggttaagtcatcgtttaaccgttgttgcaa

SEQ ID NO: 237932 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtgagtcatcgtttaaccgtttgttgcaa

SEQ ID NO: 237933 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagttatcgtttaaccgtttgttgcaa

SEQ ID NO: 237934 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtctcgttcaacctgtttgttgcaa

SEQ ID NO: 237935 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcattgtctaaccgtttgttgcaa

SEQ ID NO: 237936 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttgaccgtttgtcgcaa

SEQ ID NO: 237937 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttatccgtttgttgcaa

SEQ ID NO: 237938 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgtttgttacaa

SEQ ID NO: 237939 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgtttgctgcaa

SEQ ID NO: 237940 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgtttattgcaa

SEQ ID NO: 237941 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccggttgttgcaa

SEQ ID NO: 237942 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgcttgctgcaa

SEQ ID NO: 237943 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaacagtttgttgcaa

SEQ ID NO: 237944 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgttgaaccgtttgttgcaa

SEQ ID NO: 237945 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtgaaaccgtttgttgcaa

SEQ ID NO: 237946 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtctaaccgtctgttgcaa

SEQ ID NO: 237947 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtctaaccgcttgttgcaa

SEQ ID NO: 237948 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtataaccgtttgttgcaa

SEQ ID NO: 237949 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcatttaaccgtttgttgcaa

SEQ ID NO: 237950 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagctcgttcattaccgtttgttgcaa

SEQ ID NO: 237951 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagccatcgtttaaccgcttgttgcaa

SEQ ID NO: 237952 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggccttcaccgtcctcgatacggacgaatg

SEQ ID NO: 237953 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggccttcaccgtcctcaatacggacgaata

SEQ ID NO: 237954 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggccttcaccgtcctcaatacggacgaacg

SEQ ID NO: 237955 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggcctccaccgtcctcaatacggacgaatg

SEQ ID NO: 237956 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggccctcaccgtcctcaatacggacgaatg

SEQ ID NO: 237957 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggcaagtcatcgttaccgtttacgttgcaa

SEQ ID NO: 237958 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccgataagtcatcgtttagccgtttgttgcaa

SEQ ID NO: 237959 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactatccgtttgtccgtcctctgtggtattgcgcatgc

SEQ ID NO: 237960 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactatccgttgtccgtcctcttgtggtattgcgcatgc

SEQ ID NO: 237961 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactataccggtaagtcatcgtttaaccgtttgttgcaa

SEQ ID NO: 237962 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactaatccggtaagttcatcggttaaccgttgttgcaa

SEQ ID NO: 237963 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acaccattccggccttcaccgtccccaatacggacgaatg

SEQ ID NO: 237964 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acaccaacactctgtatacgctggactacccgcgtttcag

SEQ ID NO: 237965 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatttggctagcgttctgcctctgtatttccccgtctgcg

SEQ ID NO: 237966 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aattcttcgagcctccaagcttgtcaagtcgttttggccc

SEQ ID NO: 237967 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aattagagacctcctacgcacgcgacctcccctgtagcta

SEQ ID NO: 237968 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aattacagtaattctgcccctctgatgaaaccggttactt

SEQ ID NO: 237969 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcctacatacgcctgggtcactctttgttctg

SEQ ID NO: 237970 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatggggcttttagcacttctcggtaacttgggcagttac

SEQ ID NO: 237971 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatggggcttttaagcacttctcggtaacttgggcagtac

SEQ ID NO: 237972 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgggcttttaagcactcctcggtaacttgggcagttac

SEQ ID NO: 237973 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgggctttaagcacttctcggtaacttgggcgagttac

SEQ ID NO: 237974 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgggctttaagcacttctccggtaacttgggcagttac

SEQ ID NO: 237975 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatccgggaccgcctcaagctagctacctccattgtccag

SEQ ID NO: 237976 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatatggtacccacggtgcgctatcaccgtttacaggtat

SEQ ID NO: 237977 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaggtccgtgacgcttctggcactatccagttgacgctca

SEQ ID NO: 237978 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaggctacttcgtgagaagtcgctctcccagcgcatgcgt

SEQ ID NO: 237979 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagctgacggctgattatgggactacccatacgtataagc

SEQ ID NO: 237980 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagcgttgtattgtcgtcgcacgctattgcgaggtaacat

SEQ ID NO: 237981 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagccggggcccgcctctagctagctacctccattgtctg

SEQ ID NO: 237982 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagccggggcccgcctcaagctagctacccccattgtctg

SEQ ID NO: 237983 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagatctcggatctggcgtgctacttggacaggttccttc

SEQ ID NO: 237984 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagatctcggatctggcgtactacttggacaggttcctcc

SEQ ID NO: 237985 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagatctcggacctggcgtactacttggacaggttccttc

SEQ ID NO: 237986 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aactttttcgccggctactgcgaggacgaagctccgccgt

SEQ ID NO: 237987 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aactattcgcatcgagcggtcgtttttcgggaatatgggc

SEQ ID NO: 237988 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aactatccgtttgtctgtcctcttgtggtattgcgcatgc

SEQ ID NO: 237989 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aactatccgtttgtccgtcctcctgtggtattgcgcatgc

SEQ ID NO: 237990 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aactatccgtatcgagcgttgtcaacaagcggctaaggcc

SEQ ID NO: 237991 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacgtcctctgcgatcatctttcaaggattaccttgatta

SEQ ID NO: 237992 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggtgccgcctcaagctagctacctccagttgtctg

SEQ ID NO: 237993 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccggggtccccgcctcaagctagctacctcatgtctga

SEQ ID NO: 237994 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccggggacccgcctcaagctagctacctccatcgtctg

SEQ ID NO: 237995 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggccgcctcaacgtctagctacctccattgtcgtg

SEQ ID NO: 237996 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggccgccctcaagctagctacctccattggtctgc

SEQ ID NO: 237997 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccggccttcaagctagctacctccattgtctg

SEQ ID NO: 237998 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
aaccgggcccgctcaacgctagctcacctccattgtcgtg

SEQ ID NO: 237999 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgctacaacgcctagctacctccattgtctg

SEQ ID NO: 238000 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgccttcaagctagctaccgtccattgtctg

SEQ ID NO: 238001 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaagtctagctacctccatcgtcgtg

SEQ ID NO: 238002 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaagtctagctaccctccattgtctg

SEQ ID NO: 238003 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaagctagctacctccattgtctgac

SEQ ID NO: 238004 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaagcctagctacctccattcgtctg

SEQ ID NO: 238005 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaacgctagctacctccattgtcgtg

SEQ ID NO: 238006 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggagtccctcctcgtcttgatgcactatcatctca

SEQ ID NO: 238007 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaattagtaccgacggccgccttgatcctccgttagtctg

SEQ ID NO: 238008 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaatcttacaggcagccacgccttgttcctcctttttctg

SEQ ID NO: 238009 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaactgggccccgcctcaagctagctacctccattgtctg

SEQ ID NO: 238010 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacggggcccgcttcaagctagctacctccattggtctg

SEQ ID NO: 238011 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacggggcccgccttcaagctagctacctccattgtctg

SEQ ID NO: 238012 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacggggcccgcctcaagctagctacctccattggtctg

SEQ ID NO: 238013 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgtggcccgcctcaagctagctacctccatggtctg

SEQ ID NO: 238014 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggtcccgcctcaagctagctacctccattatctg

SEQ ID NO: 238015 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggtccgcttcaagctagctacctccattgtctg

SEQ ID NO: 238016 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggtccgcctcaagctagctacctccactgtctg

SEQ ID NO: 238017 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggctcgcctcaagctagcaacctccattgtctg

SEQ ID NO: 238018 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccgccttcaagctagctaccaccattgtctg

SEQ ID NO: 238019 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccgcctcaaggctagctacctccattgtctg

SEQ ID NO: 238020 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccgcctcaaagctagctacctccattgtctg

SEQ ID NO: 238021 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcgagctggctacctccattgtctg

SEQ ID NO: 238022 - skipped

SEQ ID NO: 238023 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaggctagctacctcaattgtctg

SEQ ID NO: 238024 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctgactacctccattgtctg

SEQ ID NO: 238025 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctgcctccagtgtctg

SEQ ID NO: 238026 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctctatcgtctg

SEQ ID NO: 238027 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccattgtatg

SEQ ID NO: 238028 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctaattccattgtctg

SEQ ID NO: 238029 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagcaacctccatcgtctg

SEQ ID NO: 238030 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaaactcagctacctccattgtca

SEQ ID NO: 238031 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaaactagctacctccgttgtctg

SEQ ID NO: 238032 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctaagactagctacctccattgtctg

SEQ ID NO: 238033 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgccccagactagctacctccatcgtctg

SEQ ID NO: 238034 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcccacactcagctacctccattgtctg

SEQ ID NO: 238035 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccccgcctcaagctagctacctcattgtctg

SEQ ID NO: 238036 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccacctcaagctagcaacctccattgtctg

SEQ ID NO: 238037 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggccggcctcaagctagctacctccattgtcttg

SEQ ID NO: 238038 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggccgccttcaagctagctacctccattggtctg

SEQ ID NO: 238039 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggccgcctcaagtctagctacctccattgtcgtg

SEQ ID NO: 238040 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggccgcctcaagctagctacctccattgtcctga

SEQ ID NO: 238041 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggccgcctcaagctagctacctccattggtctgc

SEQ ID NO: 238042 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggccgcctcaagctagctacctccattggtctga

SEQ ID NO: 238043 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagtctagctacctctattgtctg

SEQ ID NO: 238044 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctagctacctccagttgtctg

SEQ ID NO: 238045 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcctcaggctagctacctccattgtctg

SEQ ID NO: 238046 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcctcaagctagctacttccattgtctg

SEQ ID NO: 238047 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcctcaagctagctacctccattgtccg

SEQ ID NO: 238048 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcctcaagctagctacccccattgtctg

SEQ ID NO: 238049 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggagcccgcctcaagctagctacctccattatctg

SEQ ID NO: 238050 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggaacccgcctcaagctagctacctccattgtctg

SEQ ID NO: 238051 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgaggcccgcctcaagctagccacctccattgtctg

SEQ ID NO: 238052 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgagacccgcctcaagctagctacctccattgtctg

SEQ ID NO: 238053 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacccggggcccgcctcaagctagctacctcattgtctg

SEQ ID NO: 238054 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacccgggcccgcctcaagctagctacctccattgtgtg

SEQ ID NO: 238055 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccatggccgcctcaagctagctacctccattgtcctg

SEQ ID NO: 238056 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaacggggcccgcctcaagctagctacctccattgtctg

SEQ ID NO: 238057 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttcttctcctgactacatgagtattaataaacgcgc

SEQ ID NO: 238058 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgatcctctcgtggtattgcgcatgc

SEQ ID NO: 238059 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgacagtcatcttcactggacacccgtgtta

SEQ ID NO: 238060 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcaggacgtcttctgcgactatcacgatt

SEQ ID NO: 238061 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctagctaccctccattgtctg

SEQ ID NO: 238062 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgattctcgcataatatgatacgtctg

SEQ ID NO: 238063 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccattgagcttctggcactatccagttgacgctca

SEQ ID NO: 238064 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctcggcactatccagttgacgctca

SEQ ID NO: 238065 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcacgcctcaagctagctacctccattgtctg

SEQ ID NO: 238066 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtccacatcaactatgatgacgcttgctgga

SEQ ID NO: 238067 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaacttatgatgacgcttgactga

SEQ ID NO: 238068 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccggcacaggaggcgtccttggtggactaccaccttat

SEQ ID NO: 238069 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtactcctcgattccgcccatacatgcatgtaa

SEQ ID NO: 238070 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctatccgtttgtccgtcctctcgtggtattgcgcatgc

SEQ ID NO: 238071 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccttttgtccgtcctctcgtggtattgcgcatgc

SEQ ID NO: 238072 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtgatatgcgcatcgc

SEQ ID NO: 238073 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccctcctcttgtggtattgcgcatgc

SEQ ID NO: 238074 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcactacgcgtatggactc

SEQ ID NO: 238075 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgacgtcttctggcactatccagttgacgctca

SEQ ID NO: 238076 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagctctggcatctatccagttgacgctaca

SEQ ID NO: 238077 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgaaacgctattttctgggaagccgcgtctcgagcgaa

SEQ ID NO: 238078 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgttattttctgggaagccgcatctcgagcgaa

SEQ ID NO: 238079 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaattctagtctctccgcctcgatctttccaagtcgctg

SEQ ID NO: 238080 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcggacagctcacttcgtctttgatcgaccacgctcataa

SEQ ID NO: 238081 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcaccgctcacttcgtctttgatcgaccacgctcataa

SEQ ID NO: 238082 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacccccgatagtcatcttcactggacacccgtgtta

SEQ ID NO: 238083 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacatctcacttcgtctttgatcgaccacgctcataa

SEQ ID NO: 238084 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccacgttcataa

SEQ ID NO: 238085 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccatctcgtcagcctcgctggccacaccgaatacgctga

SEQ ID NO: 238086 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgtcagccacatcaactatgatgacgcttgactgga

SEQ ID NO: 238087 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgttgtccgtcctcttgtcggtattgcgcatgc

SEQ ID NO: 238088 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taatctggtacttatcatgcgctatcatgacggctaggac

SEQ ID NO: 238089 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgataccgcccatacatgcatgtaa

SEQ ID NO: 238090 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttcttctccttgactacatgagtattaataaacgcgc

SEQ ID NO: 238091 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattataaacgacgc

SEQ ID NO: 238092 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggccaggacgtctttcgtgcactatcacgat

SEQ ID NO: 238093 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactatcacgttt

SEQ ID NO: 238094 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggaagtctttcgtgcactatcacgatt

SEQ ID NO: 238095 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccatggtacgcctcgattccgcccatacatgcatgtaa

SEQ ID NO: 238096 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctcttgtggtgttgcgcatgc

SEQ ID NO: 238097 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggtttccctaacgccgttagccttccggaatg

SEQ ID NO: 238098 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccgatagtcgatcttcactggaccacccgtgtta

SEQ ID NO: 238099 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggaccacccgtgata

SEQ ID NO: 238100 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtcatcttcactggacacccgtgttg

SEQ ID NO: 238101 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactattcgtttgtccgtcctctcgtggtattgcgcatgc

SEQ ID NO: 238102 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtcgtccctcttgtggtattgcgcatgc

SEQ ID NO: 238103 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtatggcgcatgc

SEQ ID NO: 238104 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctgtggtattgcgcatgcc

SEQ ID NO: 238105 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctatggtattgcgcatgc

SEQ ID NO: 238106 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtcccgtcctctgtggtattgcgcatgc

SEQ ID NO: 238107 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcctgtggtattgcgcatgtc

SEQ ID NO: 238108 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctacttgtggtattgcgcatgc

SEQ ID NO: 238109 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcctcttgtggtattgcgcatgc

SEQ ID NO: 238110 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attgaatccagcgacttcggtggtgtcctctccattacca

SEQ ID NO: 238111 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttcggtggtgtcctctccattaccg

SEQ ID NO: 238112 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacatacgcctgggtcactcttcgttctg

SEQ ID NO: 238113 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggccgctcaacgtctagctacctccattgtcgtg

SEQ ID NO: 238114 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgctcaacgtctagctacctccattgtctg

SEQ ID NO: 238115 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttgacaccttcagccgccatgctgatgaatggtgtcatg

SEQ ID NO: 238116 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgcgactacgctcttgagcaattctgatccctggattt

SEQ ID NO: 238117 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgcgactacgctcttgaacagttctgatccctggattt

SEQ ID NO: 238118 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggcacagctcacttcgtctttgatcgaccacgctcataa

SEQ ID NO: 238119 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaacgctacttttctgggaagccgcatctcgagcgaa

SEQ ID NO: 238120 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcgtctcgagtgaa

SEQ ID NO: 238121 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatcacgagcgaa

SEQ ID NO: 238122 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttctggaatgccgcatctcgagccgaa

SEQ ID NO: 238123 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaaacgctatttctgggaagccgcatctcgagcgaa

SEQ ID NO: 238124 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccacggtcataa

SEQ ID NO: 238125 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcatctttgatcgaccacgctcataa

SEQ ID NO: 238126 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
tcgcacacctcacttcgtctttgatcgaccacgctcataa

SEQ ID NO: 238127 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgccgcttgactgga

SEQ ID NO: 238128 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttgactggc

SEQ ID NO: 238129 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactacgatgacgcttggctgga

SEQ ID NO: 238130 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgactgacgcttgactga

SEQ ID NO: 238131 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattatccgtttgtccgtcctcttgtggtattgcgcatgc

SEQ ID NO: 238132 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggggcttttaagcacttctcggtaattgggcagtta

SEQ ID NO: 238133 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggttaacttggcagttac

SEQ ID NO: 238134 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctattctcggtaacttgggcgagttac

SEQ ID NO: 238135 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacctctcggtaacttggcgagttac

SEQ ID NO: 238136 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaaagcactttctcggataacttggcagtac

SEQ ID NO: 238137 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttctagtcacttctcggtaacttggcgagttac

SEQ ID NO: 238138 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatccgccagccacatcagctatgatgacgcttgactgga

SEQ ID NO: 238139 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatatgcctgtcttttaatctcggcagagtgctcatgagc

SEQ ID NO: 238140 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgatccgtactttcaggcgctatcctggtcacccga

SEQ ID NO: 238141 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttgttcgtcctcttgtggtattgcgcatgc

SEQ ID NO: 238142 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttgtccgtcctcttgtggcattgcgcatgc

SEQ ID NO: 238143 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttgtccgccctcttgtggtattgcgcatgc

SEQ ID NO: 238144 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtctgtccgtcctcttgtggtattgcgcatgc

SEQ ID NO: 238145 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taatcgccagccacatcaactatgatgacgcttgactgga

SEQ ID NO: 238146 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggagcgcctcgatcctcgcataatatggtacgtctg

SEQ ID NO: 238147 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcggataatatgatacgtctg

SEQ ID NO: 238148 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgatacgactg

SEQ ID NO: 238149 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatgagacgtctg

SEQ ID NO: 238150 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgatgtacgcctcgattccgccatacatgacatgtaa

SEQ ID NO: 238151 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgcctcgattcctcgccatatatgatacgtctg

SEQ ID NO: 238152 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccattgtacgcctcgattccgcccatacatgcatgtaa

SEQ ID NO: 238153 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatgtacgcctcgattccgcccatacattgcatgtaa

SEQ ID NO: 238154 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatgtacgcctcgattccgcccatacatgacatgtaa

SEQ ID NO: 238155 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcgtcgattccgcccatacatgcatgtaa

SEQ ID NO: 238156 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcggttccgccactacatgcatgtaa

SEQ ID NO: 238157 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgatttccgcccatactgcatgtaa

SEQ ID NO: 238158 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacctgcatgtaa

SEQ ID NO: 238159 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccccccatacatgcatgtaa

SEQ ID NO: 238160 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattcagcccatacatgcatgtaa

SEQ ID NO: 238161 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgccctcgattccgccatacatgcatgtaa

SEQ ID NO: 238162 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcatcgattccgcccatacatgcatgtaa

SEQ ID NO: 238163 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggattgtacccgaacggggtt

SEQ ID NO: 238164 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcagattgtacccgaactgggtt

SEQ ID NO: 238165 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccttcgtcttagcggcgctctgtggtaagattctat

SEQ ID NO: 238166 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccatcgtctagtgagtcgcccttagttcatcaaggc

SEQ ID NO: 238167 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttgcttctcctgactacatgagtattaataaacgcgc

SEQ ID NO: 238168 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttcttctccgtgactacattgagattaataaacgcgc

SEQ ID NO: 238169 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactatatgagattaataaacgcgc

SEQ ID NO: 238170 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagatttataaacgcgc

SEQ ID NO: 238171 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacaagagattaataaacgcgc

SEQ ID NO: 238172 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttgcttctcctgactacatgagattaataaacgcgc

SEQ ID NO: 238173 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttcttctcctgactacatgagattaataaacgcgcc

SEQ ID NO: 238174 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttctcttcctcgactacatgagattaataaacgcgc

SEQ ID NO: 238175 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtatcttctcctgactacatgagattaataaacgcgc

SEQ ID NO: 238176 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttggtgggggactaccccctcgta

SEQ ID NO: 238177 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggtttggtgggggactaccccccttgta

SEQ ID NO: 238178 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcactatcgtttgtccgtcctcttgtggtattgcgcatgc

SEQ ID NO: 238179 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctggcatactacttggacaggttccttc

SEQ ID NO: 238180 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctgcgtcactacttggacaggttccttc

SEQ ID NO: 238181 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactatccgcttgtccgtcctcttgtggtattgcgcatgc

SEQ ID NO: 238182 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccggggtccgcctcaagctagctacctccattgtctg

SEQ ID NO: 238183 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccgggcccgctcaacgtctagctacctccattgtctg

SEQ ID NO: 238184 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttgagtattagtcagcccgcctcgcatccttccacggac

SEQ ID NO: 238185 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactatcatctca

SEQ ID NO: 238186 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttagtccgcaggacgtctttcgtgcactatcacgatt

SEQ ID NO: 238187 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctatccggcaggacgatctttcgtgcactatcatcgat

SEQ ID NO: 238188 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcgtatccggcaggacgtctttcgtgcactatcacgatt

SEQ ID NO: 238189 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccggaacgcctcgatcctcgcataatatgatacgtctg

SEQ ID NO: 238190 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcccatccggcaggacgtctttcgtgcactatcacgatt

SEQ ID NO: 238191 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgtcaccccgatagtcaatcttcactggacacccgtgtta

SEQ ID NO: 238192 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgagcgagcactttgtgcgaccacaca

SEQ ID NO: 238193 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgacgtagcactttgtgcgatcacaca

SEQ ID NO: 238194 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgacgagcgactttgtgcgatcacaca

SEQ ID NO: 238195 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctcttgtggtattgcgcatac

SEQ ID NO: 238196 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctcttgtggtactgcgcatgc

SEQ ID NO: 238197 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctctggtggtattgcgcatgc

SEQ ID NO: 238198 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtcatcgagcggttcttcgataatatgcaaca

SEQ ID NO: 238199 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccgggagtccctcctcgtcttgatgcactatcatctca

SEQ ID NO: 238200 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgactatccgtttgtccgcctcttgtggtattgcgcatgc

SEQ ID NO: 238201 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtcaccccgatagtcatcttcactggacaacccgtgta

SEQ ID NO: 238202 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcgccccgattagtcatcttcactggacacccgtgtta

SEQ ID NO: 238203 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctctagcctccatgtaatctctccctaatgcgtctg

SEQ ID NO: 238204 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgtggaaccttcgattgctac

SEQ ID NO: 238205 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccacccgatagtcatcttcgctggaccacccgcgtta

SEQ ID NO: 238206 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacctccgatagtcatcttcactggacacccgtgtta

SEQ ID NO: 238207 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgattagtccatcttcactggacacccgtgta

SEQ ID NO: 238208 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcgctgggccacccgtgtta

SEQ ID NO: 238209 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcgctggactacccgtgtta

SEQ ID NO: 238210 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggatcacccgtgtta

SEQ ID NO: 238211 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggacaccctgtgtta

SEQ ID NO: 238212 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgactagtcatcttcgctggaccaccgcgtta

SEQ ID NO: 238213 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtcgtcttcactggacacccgtgtta

SEQ ID NO: 238214 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtcatcttcgctggacacccgtgtta

SEQ ID NO: 238215 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccccgatagtcatcttcactggacaccgtgtta

SEQ ID NO: 238216 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccaatagttcatcttcactggacacccgtgtta

SEQ ID NO: 238217 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccctatccgtttgtccgtcctctcgtggtattgcgcatgc

SEQ ID NO: 238218 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgcaccccgatagtcatcttcactggacacccgtgtta

SEQ ID NO: 238219 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccctgaaacgtccacatgggctgcaaccggtattgcgcg

SEQ ID NO: 238220 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccacaccccgatagtcatcttcactggaccacccgtgtta

SEQ ID NO: 238221 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattatccgcttgtccgtcctctcgtggtattgcgcatgc

SEQ ID NO: 238222 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catcgtggacctcctttctcggatccaaacacaattgcac

SEQ ID NO: 238223 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagtcgatccgtactttcaggcgctatcctgatcacccga

SEQ ID NO: 238224 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcgtttcgctcgtcctcttgtggtattgcgcatgc

SEQ ID NO: 238225 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtcgtcctcttgtggtaattgcgcatgc

SEQ ID NO: 238226 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtgctctcgtggtattgcgcatgc

SEQ ID NO: 238227 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtctcttcgtggtattgcgcatgc

SEQ ID NO: 238228 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggcattacgcatgc

SEQ ID NO: 238229 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttcagtgtatgcgcatcg

SEQ ID NO: 238230 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttatggtattgcgcgtgc

SEQ ID NO: 238231 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttatggtattgcgcatac

SEQ ID NO: 238232 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctgtggtattgcgcactgc

SEQ ID NO: 238233 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgcgcattc

SEQ ID NO: 238234 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgcgcatga

SEQ ID NO: 238235 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtgctattgcgcatgc

SEQ ID NO: 238236 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcctggtattgcgcatgc

SEQ ID NO: 238237 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggtattgcgcgtgc

SEQ ID NO: 238238 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggtattgcgcatcg

SEQ ID NO: 238239 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccggcctcttgtggtattgcgcatgc

SEQ ID NO: 238240 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgccctcttatggtattgcgcatgc

SEQ ID NO: 238241 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtccttcttgtggtattgcgcatgt

SEQ ID NO: 238242 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtccttcttgtgcattgcgcatgtc

SEQ ID NO: 238243 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtgattgcgcatgc

SEQ ID NO: 238244 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtattgcgcgtgtc

SEQ ID NO: 238245 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtattgacgcatgc

SEQ ID NO: 238246 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtcggtgttgcgcatgc

SEQ ID NO: 238247 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttctgtccgtcctcttgtggattgcgcatgc

SEQ ID NO: 238248 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttagatccgtcactcactacgcgtatggatc

SEQ ID NO: 238249 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtcctcttgtggtattgcgcgtgc

SEQ ID NO: 238250 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtcctcttgtggtactgcgcatgc

SEQ ID NO: 238251 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcactacgcgtgtggaatc

SEQ ID NO: 238252 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgcggtattgcgcatgc

SEQ ID NO: 238253 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgaggtattgcgcatgc

SEQ ID NO: 238254 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
cactatccgacatcgagagagctacgtcatcaagcgcaaa

SEQ ID NO: 238255 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccctttgtccgtcctcttgtggtattgcgcatgc

SEQ ID NO: 238256 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacctatcgttgtccgtcctcttgtcggtattgcgcatgc

SEQ ID NO: 238257 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgtatcgagggttttgtccggtccacgactgac

SEQ ID NO: 238258 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatacttgatctcctgtcgactctgcggctgagactact

SEQ ID NO: 238259 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgagtcttctggcactatccgagttgacgctca

SEQ ID NO: 238260 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgacgcttctggcgtctatccagttgacgctca

SEQ ID NO: 238261 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgacgcttctcggcactatcgagttgacgctca

SEQ ID NO: 238262 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagtcctctggcactatccagttgacgctca

SEQ ID NO: 238263 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactatccagttgacgctcca

SEQ ID NO: 238264 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactatccagttgaccgctca

SEQ ID NO: 238265 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccagtgagcttctggcactatccagttgacgctca

SEQ ID NO: 238266 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atctgagtgcaccagctagcctcgcgcctcctcaagcttg

SEQ ID NO: 238267 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgccttgattccgcccatacatgcatgtaa

SEQ ID NO: 238268 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcaattccgcccatacatgcatgtaa

SEQ ID NO: 238269 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ataccggtacgccttgtgtcgcccgtgtgttgcaaccaga

SEQ ID NO: 238270 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agctttctcggatccaaacgcatatcctcctccgcctcgt

SEQ ID NO: 238271 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agactactccgatggacgatcgtaacttaggagtcgccta

SEQ ID NO: 238272 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acctgcttgtgtgcgacacatgtctacgactcctcctcag

SEQ ID NO: 238273 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acctctccgggtgagcgagtttggcacagcactatctctg

SEQ ID NO: 238274 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtctaaccgtttgttgcga

SEQ ID NO: 238275 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcaccgtctaaccgtttgttgcaa

SEQ ID NO: 238276 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgggctttaagcacttctcggtaacttgggcagcttac

SEQ ID NO: 238277 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagatctcggatttggcgtactacttggacaggttccttc

SEQ ID NO: 238278 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccggggcccgcctcaagctagctacctccattgtctgc

SEQ ID NO: 238279 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgccttcaagctagctacctccattggtctg

SEQ ID NO: 238280 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaagtctagctacctccattgtctgc

SEQ ID NO: 238281 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaagctagctaccttccattgtcctg

SEQ ID NO: 238282 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcttcaagctagctacctcctttgtctg

SEQ ID NO: 238283 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggccgcctcaacgtctagctacctccattgtctg

SEQ ID NO: 238284 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgctcaagtctagctacctccattgtcgtg

SEQ ID NO: 238285 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctccaagctagctacctccattgtctg

SEQ ID NO: 238286 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttttagtctcccgttcgcacgtacttcccatcaccgcatg

SEQ ID NO: 238287 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttgtctctcgggtccattctcgccgcaccttccccagga

SEQ ID NO: 238288 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttggtccatgagcttctggcactatccagttgacgctca

SEQ ID NO: 238289 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttgggctttaagcacttctcggtaacttgggcagcttac

SEQ ID NO: 238290 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttgggaagcgggactggtcgaggcgctatcctcgactta

SEQ ID NO: 238291 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttaaggcgctaaccagctaattagcatggcccctaactg

SEQ ID NO: 238292 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttaagcgcacctagctaatgagcatggccccttaactcg

SEQ ID NO: 238293 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttaagcgcaccagtctaatacgcattggccccttaactg

SEQ ID NO: 238294 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tttaagcgcaccagctaatagtcatggccccccttaactg

SEQ ID NO: 238295 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgtccatgagctctgacatctatccagttgacgtctcga

SEQ ID NO: 238296 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgtaccccgggttgcaattgcctcgtaaccggaccgcat

SEQ ID NO: 238297 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgtaccccgggttgcaattgcctcgtaaccagaccgcac

SEQ ID NO: 238298 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgtaccccgggtcgcaattgcctcgtaaccagaccgcat

SEQ ID NO: 238299 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttggggctcttaagcacttctcggtaacttgggcagttac

SEQ ID NO: 238300 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgggcgccttacaccgcctttggtccagtcacgcgtacg

SEQ ID NO: 238301 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgcgaaacgctatttctgggaagccgcatctcgagcgaa

SEQ ID NO: 238302 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgatcatataaagccggcttgctcgcctcggtcctccat

SEQ ID NO: 238303 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgagccccgggttgcaattgcctcgtaaccagaccgcat

SEQ ID NO: 238304 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgactaccttccgctgcgtgtactcgtccttttcgtctg

SEQ ID NO: 238305 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgactaccttccgctgcgcgtactcgtcctttttgtctg

SEQ ID NO: 238306 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttgaatcctgctttaggcgcctcttaagggttccattttt

SEQ ID NO: 238307 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcttatccggcaggatgtctttcgtgcactatcacgatt

SEQ ID NO: 238308 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcttatccggcaggacgtgtttcgtgcactatcacgatt

SEQ ID NO: 238309 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcttatccggcaagacgtctttcgtgcactatcacgatt

SEQ ID NO: 238310 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttctgggtacgctcgactacgaccggtacaccctgtacag

SEQ ID NO: 238311 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttctgggcactatcccagccttgagcatctccgtcgggtt

SEQ ID NO: 238312 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcggcatcagctttcgggcgctatcccgatccagctgca

SEQ ID NO: 238313 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcgcgatagtcctcggttcttccatgcagccgcatatta

SEQ ID NO: 238314 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcgcgaacgccttagtcaccctcctcggataacacgatt

SEQ ID NO: 238315 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcgaaacgctattttctgggaagccgcatctcgagcgaa

SEQ ID NO: 238316 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttccaagcgctatcttggccagttcagcatttatagtgtc

SEQ ID NO: 238317 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcaggaccgcagatcgcctcgtcttcgcagtatgcccgg

SEQ ID NO: 238318 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcagccttctcttgactacacgagtttcagctgttgcct

SEQ ID NO: 238319 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcagcatgctctggatccctggactacccgggaaatagt

SEQ ID NO: 238320 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttcaagcgcacagtctactacgcgtggcccccccttaatg

SEQ ID NO: 238321 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttatccctgacgatccgtattctcatcggctggcactatc

SEQ ID NO: 238322 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttatccctaatgatccgaattctcatcggctggcactatc

SEQ ID NO: 238323 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttatccccgatcgatctgaattctcatcgctggcactatc

SEQ ID NO: 238324 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttatacgatcgaatcgcgcacattacgtacactgcgcccg

SEQ ID NO: 238325 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttagggccctaacatggcctcggtcccccgtcgtagtgca

SEQ ID NO: 238326 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttagactagtccggcatcgcctcagtcctgccatccgcat

SEQ ID NO: 238327 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttagaatgtgtgatagtctcgggcattcctgcctccacat

SEQ ID NO: 238328 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttactttctcggatcactgattgccgcatcacgcactccc

SEQ ID NO: 238329 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttactttctcggatcactaattgccgcctcacgcactccc

SEQ ID NO: 238330 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttactttctcggatcactaattgccgcatcacgcaccccc

SEQ ID NO: 238331 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttactccggatgagccacctcgcattcctccgttcgtctg

SEQ ID NO: 238332 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ttaagcgcaccagtctaatcacgcattggccccttaactg

SEQ ID NO: 238333 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgttcgcgattgccgcttgtgtttcgctccctggagactt

SEQ ID NO: 238334 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgttcgccagtcacgtcaactatgatgacgcttgactgga

SEQ ID NO: 238335 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgttcgccagtcacatcaactatgatgacgcttgactgaa

SEQ ID NO: 238336 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgttcgccagtcacatcaactataatgacgcttgactgga

SEQ ID NO: 238337 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgttcgccagctacatcaactatgatgacgcttgactgga

SEQ ID NO: 238338 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtggggcttttaagcacttctcggtaactgggcagttac

SEQ ID NO: 238339 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgcgactacgtctcttgaacaattctgatccctggatt

SEQ ID NO: 238340 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgcgaccacgctcttgaacaattctgatccctggactt

SEQ ID NO: 238341 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgcaacgccttgattcactcctacagtgtgtctataga

SEQ ID NO: 238342 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtgaacgaccatgctctaggcgcctctaccgggaagctt

SEQ ID NO: 238343 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtctgaccctgttatggactaccatatcagaaaggtact

SEQ ID NO: 238344 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtcgccagcctacatcaactatgatgacgcttgactgga

SEQ ID NO: 238345 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtcgcagtctacatcaactatgagtgacgcttgactgga

SEQ ID NO: 238346 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtcgaaacgctatttctggaagccgcatctcgaagcgaa

SEQ ID NO: 238347 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtccatgacgcttctggcatctatccagttgacgctcta

SEQ ID NO: 238348 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtagtcgcctgtccgccttcgatcctctataccgtctgt

SEQ ID NO: 238349 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtggcctggtccgcctcgatcctctataccgtctg

SEQ ID NO: 238350 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgtctggtccgcctcgatcctctataccgtctg

SEQ ID NO: 238351 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgtctcgatcctctataccgtctg

SEQ ID NO: 238352 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcctcgctcctctataccgtctg

SEQ ID NO: 238353 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcctcgatcctctacaccgtctg

SEQ ID NO: 238354 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcctcgatccactataccgtctg

SEQ ID NO: 238355 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtccgcctccggtcttccccaggttaa

SEQ ID NO: 238356 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtaggtcgcctggtcccgcctcggtctctataccgtctg

SEQ ID NO: 238357 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtagatcgttcttatccgcctcggtcttccccgagttaa

SEQ ID NO: 238358 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggtccatgagcttctggcacgtattccagttgacgctca

SEQ ID NO: 238359 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggtccagtgagcttctggcactactccagttgacgctca

SEQ ID NO: 238360 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgggctttcttcatggactaccatgttacaaaagatcata

SEQ ID NO: 238361 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggccctcgccttgttccttccgttaactactggcgttag

SEQ ID NO: 238362 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggagtccgcggtttcactagactactactgatcacgccg

SEQ ID NO: 238363 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tggacccgggcacttgcctcagttctctctacaggcgaat

SEQ ID NO: 238364 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgctatccgtttgtccgtcctcttgtggtattgcgcatgc

SEQ ID NO: 238365 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgctatccgccatcgagcgagcagtgtgccgttttcggtg

SEQ ID NO: 238366 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgctatccgccatcgagcgaacagtgtgccgttttcagtg

SEQ ID NO: 238367 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgctatccgcatcgagcgggctcttcgataatatgcaaca

SEQ ID NO: 238368 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgctatccgaatcgagcttgagtgtctggctaaacaacga

SEQ ID NO: 238369 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgtaaacgctattttctgggaaccgcgtctcgagcgaa

SEQ ID NO: 238370 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgtaaacgctatttctgggaagccgcatctcgagcgga

SEQ ID NO: 238371 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgtctcatttctggaagccgcatctcgagcgaa

SEQ ID NO: 238372 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgattcactcctacagtgtgtctataaa

SEQ ID NO: 238373 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgattcactcctacagtgtgactataga

SEQ ID NO: 238374 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgccttgattcactcctacagtgtatctataga

SEQ ID NO: 238375 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaacgcctcgattcactcctacagtgtgtctataga

SEQ ID NO: 238376 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgcaaacgctatttctggaagccgcatctcgagccgaa

SEQ ID NO: 238377 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgagacgctattttctgggaagccgcgtctcgagcgaa

SEQ ID NO: 238378 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaacgctattttctgggaagccgtatcgtcgagcgaa

SEQ ID NO: 238379 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaacgctattttctgggaagccgcatctcgagccgaa

SEQ ID NO: 238380 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaacgctattttctcgggaagccgcatctcgagcgaa

SEQ ID NO: 238381 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgtgaagccgcatctcgagcgaa

SEQ ID NO: 238382 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
tgcgaaacgctattttctgggtagccgcatctcgagcgga

SEQ ID NO: 238383 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaatccgcatctcgagcgaa

SEQ ID NO: 238384 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgtgtctcgagcgaa

SEQ ID NO: 238385 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccggatctcgagcgaa

SEQ ID NO: 238386 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgctactcgagcgaa

SEQ ID NO: 238387 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcgtcacgagcgaa

SEQ ID NO: 238388 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatctcgagcgtg

SEQ ID NO: 238389 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatcgtgagcgaa

SEQ ID NO: 238390 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatcctcagcgaa

SEQ ID NO: 238391 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcatcccgagcaaa

SEQ ID NO: 238392 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcacatcgagcgaa

SEQ ID NO: 238393 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccccatctcgagcgaa

SEQ ID NO: 238394 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccacatctcgagagaa

SEQ ID NO: 238395 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagacgcatctcgagcgaa

SEQ ID NO: 238396 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaaaccgcgtctcgagcgaa

SEQ ID NO: 238397 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctggaagccgcatctcgagctgaa

SEQ ID NO: 238398 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctcggaagccgcatctcgagcgaa

SEQ ID NO: 238399 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttcagggaagccgcatctcgagcgaa

SEQ ID NO: 238400 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttctgtcgaagccgcatctcgagcgaa

SEQ ID NO: 238401 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttctgggaatgccgcatctcgagcgat

SEQ ID NO: 238402 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttctgggaatgccgcatctcaagcgaa

SEQ ID NO: 238403 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttctgggaagccgctatctcgagcgaa

SEQ ID NO: 238404 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttctgggaagccgcatctcggagcgaa

SEQ ID NO: 238405 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttctgggaagccgcatctcgagctgaa

SEQ ID NO: 238406 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttctgggaaatccgcatctcgagcgaa

SEQ ID NO: 238407 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttctgggaaagccgcatctcgagcgaa

SEQ ID NO: 238408 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttctggaatgccgcagtctcgagcgaa

SEQ ID NO: 238409 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttctcgggaaccgctgtctcgagcgaa

SEQ ID NO: 238410 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttcctgggaagccgcgtctcgagcgaa

SEQ ID NO: 238411 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatttactgggaagccgcgtctcgagcgaa

SEQ ID NO: 238412 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattctctgggaagccgcatctcgagcgag

SEQ ID NO: 238413 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctatattctgggaagccgcgtctcgagcgaa

SEQ ID NO: 238414 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctacttttctggaagccgcatctcgagcgaa

SEQ ID NO: 238415 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgcgtatttctgggaagccgcatctcgagcgaa

SEQ ID NO: 238416 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgcctatttctgggaagccgcatctcgagcgaa

SEQ ID NO: 238417 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgccattttctgggaagccgcgtctcgagcgaa

SEQ ID NO: 238418 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgccattttctgggaagccgcatctcgggcgaa

SEQ ID NO: 238419 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgccattttctgggaagccgcatctcgagcgat

SEQ ID NO: 238420 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgccggaagtccctcctcgtcttgatgcactatcatctca

SEQ ID NO: 238421 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgccgcctccgatcctccattgggtggccataccaatgta

SEQ ID NO: 238422 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgccgcaacgcctgattcactcctacagtgtgtctataga

SEQ ID NO: 238423 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgccgaaacgctattttctggaagccgcatctcgagcgaa

SEQ ID NO: 238424 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcagaggccctcgtgttggactaccaacttgtagaacgg

SEQ ID NO: 238425 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcaaacagctattttctgggaagccgcatctcgagcgaa

SEQ ID NO: 238426 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcaaaacgctattttctgggaagccgcatctcgagcgaa

SEQ ID NO: 238427 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatgggcctttaagcacttctcggtaacttgggcagtac

SEQ ID NO: 238428 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatctggtacctatcatgcgctatcatgacggctaggac

SEQ ID NO: 238429 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatcgccagccacatcaactatgatgacgcttgactgga

SEQ ID NO: 238430 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgatcctcttccgtctttcgttcttccgtaggtgcgcgca

SEQ ID NO: 238431 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgataacgcctgtctttaatctcgcagagtgctcatgagc

SEQ ID NO: 238432 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgagtgtatacccctccgcattatcgccgcatctcgtttg

SEQ ID NO: 238433 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgagccatggatcactgcctcgattcgtccacgtgttggc

SEQ ID NO: 238434 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgactacatatactacgaattccacccctctacatcgccg

SEQ ID NO: 238435 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgactacaccggtggccatcgtcacgcgcacgatcgatct

SEQ ID NO: 238436 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgactacaccggtgccatcgtcacgcgcacgatcgatctc

SEQ ID NO: 238437 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgactaacattcatcgagcgaacgcctaagtgctagtact

SEQ ID NO: 238438 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgacgtccgcggtttcactagactactactgatcacgtcg

SEQ ID NO: 238439 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgacgggctttaagcacttctcggtaacttgggcagttac

SEQ ID NO: 238440 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgacgaacgtctatttctgggaagccgcatctcgagcgaa

SEQ ID NO: 238441 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgacgaacgctatttctgggaagccgcgtctcgaagcgaa

SEQ ID NO: 238442 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaatgtccgcggttcactagactactactgaccacgtcg

SEQ ID NO: 238443 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaatataacccggtagctaccgccttatgtttccgtgta

SEQ ID NO: 238444 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagttcgcggtttcactagactactactgatcacgtcg

SEQ ID NO: 238445 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcgtactcactagactactactgatcacgtcg

SEQ ID NO: 238446 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagcctactactgatcacgccg

SEQ ID NO: 238447 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagactgctactgatcacgtcg

SEQ ID NO: 238448 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtttcactagactactactgatcacgtta

SEQ ID NO: 238449 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggttcactagatctactactgatcacatcg

SEQ ID NO: 238450 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggttcactacgactactactgatcacgtcg

SEQ ID NO: 238451 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggtgtcactagactactactgatcacgtcg

SEQ ID NO: 238452 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcggcttcactaggctactactgatcacgtcg

SEQ ID NO: 238453 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtccgcagtttcactagactactactgatcacgtcg

SEQ ID NO: 238454 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttgctagtcggagtcgtcttcgagccccatgcgcgtat

SEQ ID NO: 238455 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctgatctgcaactgttcgagccacttgctcgctctaatc

SEQ ID NO: 238456 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctctaatccgcagttcgtcgattctgcactatcgacgat

SEQ ID NO: 238457 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctcgtatcttccggtaattaccacgtacgtacatgtctg

SEQ ID NO: 238458 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctcccaagtttagtcgtctttcgaggactaccttcgttc

SEQ ID NO: 238459 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctcccaagcttagtcgtctttcgaggactacctcgtttc

SEQ ID NO: 238460 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tctaacgtcccaattcgtcgtccgtacgctattacggttt

SEQ ID NO: 238461 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgtgtccatgagcttctggcactatccagttgacgctca

SEQ ID NO: 238462 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgtggcctttaagcgacttctcggtaccttggcagttac

SEQ ID NO: 238463 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgtcgtgtcgtggactaccatcagaagaatcgactgtcg

SEQ ID NO: 238464 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgtcgatccgtactttcaggcgctatcctgatcacccga

SEQ ID NO: 238465 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgtccttatcggctagacggtcttctgcactatcacgat

SEQ ID NO: 238466 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgtcacagctcacttcgtctttgatcgacacgctcataa

SEQ ID NO: 238467 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcctcgaacactgacgtcgtggaaccttcgattgccag

SEQ ID NO: 238468 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcctagtctatttcacgcgccatcgtgatcaaacaact

SEQ ID NO: 238469 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgccatcctgtcttgcgagactactcgctcaacggcaga

SEQ ID NO: 238470 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcactgcacacttcgtctttgatcgaccacgctcataa

SEQ ID NO: 238471 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcactagctcactcgtctttgatcgaccacgctcataa

SEQ ID NO: 238472 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacggctcacttcgtctttgatcgactacgctcataa

SEQ ID NO: 238473 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacggctcacttcgtctttgatcgaccacgttcataa

SEQ ID NO: 238474 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcaccccgattagtcatcttcactggacacccgtgtta

SEQ ID NO: 238475 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcaccccgatagtcgtcttcgctggaccacccgtgtta

SEQ ID NO: 238476 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcaccccgatagtcatcttcgctggaccacccgcgtta

SEQ ID NO: 238477 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcaccccgatagtcatcttcactggaccacccgtgttt

SEQ ID NO: 238478 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcaccccgatagctcatcttcactggacacccgtgtta

SEQ ID NO: 238479 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacccccgatagtcatcttcgctggaccaccgcgtta

SEQ ID NO: 238480 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcaccagctcacttgtctttgatcgaccacgctcataa

SEQ ID NO: 238481 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacatctcacttcgtctttggtcgaccacgctcataa

SEQ ID NO: 238482 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagttcacttcgtctttgatcgaccacgctcataa

SEQ ID NO: 238483 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagcttacttcgtctttgatcgaccacgcccataa

SEQ ID NO: 238484 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcactttgtctttgatcgaccacgctcatga

SEQ ID NO: 238485 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgttcgaccacgctcataa

SEQ ID NO: 238486 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttggtcgactacgctcataa

SEQ ID NO: 238487 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttggtcaaccacgctcataa

SEQ ID NO: 238488 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatctaccacgctcataa

SEQ ID NO: 238489 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccacgcttataa

SEQ ID NO: 238490 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccacgctcatat

SEQ ID NO: 238491 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccacgcccatga

SEQ ID NO: 238492 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtctttgatcgaccacccgtgtta

SEQ ID NO: 238493 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgtcttgatcgaccacgcatcataa

SEQ ID NO: 238494 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgcctttgatcgaccacgctcatga

SEQ ID NO: 238495 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgatctttgatcgaccacgctcata

SEQ ID NO: 238496 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacttcgactttgatcgaccacgctcataa

SEQ ID NO: 238497 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacctctcttttgatcgaccacgctcataa

SEQ ID NO: 238498 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacctcgtctttgatcgaccacgctcatga

SEQ ID NO: 238499 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagctcacctcgtcttcgatcgaccacgctcataa

SEQ ID NO: 238500 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagcctacttcgtctttgatcgaccacgctcataa

SEQ ID NO: 238501 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagcccatttcgtctttgatcgaccacgctcataa

SEQ ID NO: 238502 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagcccacttcgtctttgatcgactacgctcataa

SEQ ID NO: 238503 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgcacagatcacttcgtctttgatcgaccacgctcataa

SEQ ID NO: 238504 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgatgggcttttaagcacttctcggtaacttggcagtta

SEQ ID NO: 238505 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgatgggcctttaagcacttctcgtaacttggcagttac

SEQ ID NO: 238506 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgatcgccagcacatcaactatgatgacgcttgactgga

SEQ ID NO: 238507 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgaccgggccccgactcaagctacgtctcgccactgtct

SEQ ID NO: 238508 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgacacagctcacttcgtcttgatcgaccacgctcataa

SEQ ID NO: 238509 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcgaaatcgtctgcttgaccgcctcaagtcttccgtatat

SEQ ID NO: 238510 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
tcctctgtgtactctcacgctaacccggggtgtgaccgtc

SEQ ID NO: 238511 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcctctgtgactctcacgctaacccgggggcgtgaccgtc

SEQ ID NO: 238512 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcctctgcgactctcacgctaacccgggggtgtgaccgtc

SEQ ID NO: 238513 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccgtctcgcacacccgtgtgcgcacacttggagactagt

SEQ ID NO: 238514 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccgccacccgatagtcatcttcactggacacccgtgtta

SEQ ID NO: 238515 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccgcaccccgatagtcatcttcactggacacccgtgtta

SEQ ID NO: 238516 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccccttcatcggaatcgataactcaccccgttgtcttga

SEQ ID NO: 238517 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcccccaagtttagtcgtctttcgaggactacctcgtttc

SEQ ID NO: 238518 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccatggtacgcctcgaattccgcccatacatgcatgtaa

SEQ ID NO: 238519 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccaggtccccaattcgtcgtccgtacgctattacggttt

SEQ ID NO: 238520 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tccaagtcccaattcgtccgtccgtacgctattacggttt

SEQ ID NO: 238521 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcattcgccagtcacatcaactatgatacgcttgactgga

SEQ ID NO: 238522 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttgagcacttctcggtaacttgggcagttac

SEQ ID NO: 238523 - skipped

SEQ ID NO: 238524 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttagcacttctcggtaacttgggacagttac

SEQ ID NO: 238525 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttaagcacttctcgttaacttgggcagttac

SEQ ID NO: 238526 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttaagcacttctcggtacttgggcagcttac

SEQ ID NO: 238527 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttaagcacttctcggtaacttgggcagttat

SEQ ID NO: 238528 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcatgggctttaagacacttcggtaacttgggccagttac

SEQ ID NO: 238529 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcagggcctttaagctacttctcgtacttgggcagcttac

SEQ ID NO: 238530 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcaccgcctcatcatcggacacgacgtgtactcagtgctg

SEQ ID NO: 238531 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattgggctttaagcacttctcgtaacttggacaagttac

SEQ ID NO: 238532 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccggtcacatcaactatgatgacgcttggctgga

SEQ ID NO: 238533 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccggtcacatcaactatgatgacgcctgactgga

SEQ ID NO: 238534 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcccgtcacatcagctatgatgacgcttgactgga

SEQ ID NO: 238535 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcgacacaacttatgatgacgcttgactga

SEQ ID NO: 238536 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcccatcaactatgatgacgcttgactgga

SEQ ID NO: 238537 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtccacatcaactatgatgacgcttgactgg

SEQ ID NO: 238538 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgctgacgcttggctgga

SEQ ID NO: 238539 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatggcgcttgtctgga

SEQ ID NO: 238540 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgactctgatctgga

SEQ ID NO: 238541 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgtctgactgga

SEQ ID NO: 238542 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttggcgtga

SEQ ID NO: 238543 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttggccgga

SEQ ID NO: 238544 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttgactgta

SEQ ID NO: 238545 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttgacctga

SEQ ID NO: 238546 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgctcggctgga

SEQ ID NO: 238547 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgctcgactggg

SEQ ID NO: 238548 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgactgacgcttgctgga

SEQ ID NO: 238549 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccatatcaactatgatgacgcttgactgga

SEQ ID NO: 238550 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgatgcttgactgga

SEQ ID NO: 238551 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgacgtttgactgga

SEQ ID NO: 238552 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgacgcttgactggc

SEQ ID NO: 238553 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgacgcttgacgtga

SEQ ID NO: 238554 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgatgacgcttgaatgga

SEQ ID NO: 238555 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatgactacgcttgactgga

SEQ ID NO: 238556 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactatcatgacgcttgactgga

SEQ ID NO: 238557 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactataatgacgcttaactgga

SEQ ID NO: 238558 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacatcaactaggatgacgcttgactgga

SEQ ID NO: 238559 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacaccaactatgatgacgcttgactggg

SEQ ID NO: 238560 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagccacaacaactatgatgacgcttgactgga

SEQ ID NO: 238561 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcagtccacatcaactatgatgacgcttgactgga

SEQ ID NO: 238562 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgcagcccacatcaactatgatgacgcttgactgga

SEQ ID NO: 238563 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattccgcagtcacatcaactatgatgacgcttgactgga

SEQ ID NO: 238564 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggggcttttaagcacttctggtagttgggcagttac

SEQ ID NO: 238565 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggggcttttaagcacttctggtaacgtgggcagtta

SEQ ID NO: 238566 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggggcttttaagcacttcggtaacctgggcagttac

SEQ ID NO: 238567 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttgagcactctcggtaacttgggcagttac

SEQ ID NO: 238568 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttagcgacttctcggtaactgggcagttac

SEQ ID NO: 238569 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttagcacttctcggtaacttggcgagttac

SEQ ID NO: 238570 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcgctctctgatacttgggcagttac

SEQ ID NO: 238571 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcactttcgtgaacttgggcagttac

SEQ ID NO: 238572 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttcttggtaacttgggcagtta

SEQ ID NO: 238573 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctggtaacttgggcggttac

SEQ ID NO: 238574 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaacttgggtagtta

SEQ ID NO: 238575 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggaacttgggcggttac

SEQ ID NO: 238576 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcgcaacttgggcagttac

SEQ ID NO: 238577 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttcgtcgtaacttggcagttac

SEQ ID NO: 238578 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttcctgatacttgggcagttac

SEQ ID NO: 238579 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttccggtaacttgggcggttac

SEQ ID NO: 238580 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcactcgtcgatacttgggcagttac

SEQ ID NO: 238581 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcactaccggtaacttgggcagttac

SEQ ID NO: 238582 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacgtctcgtaacgttggcagttac

SEQ ID NO: 238583 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttagagcactttctcggtaactggcagttac

SEQ ID NO: 238584 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttagacacttctcggtaacttggcgagttac

SEQ ID NO: 238585 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttacagcacttctcgtaacttgggcagttac

SEQ ID NO: 238586 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttacagcacttctcggtaacttgggcattac

SEQ ID NO: 238587 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagctcttctcggtaacttggcagttaac

SEQ ID NO: 238588 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcgactctcggtaacttgggcagttac

SEQ ID NO: 238589 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctgggtaacttgggcagttac

SEQ ID NO: 238590 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtatcttgggcagttac

SEQ ID NO: 238591 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaatttgggcagttac

SEQ ID NO: 238592 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttgggcagttat

SEQ ID NO: 238593 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttgggcagtaac

SEQ ID NO: 238594 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctcggtaacttgatcagttac

SEQ ID NO: 238595 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcacttctccgtaacttgggcagttac

SEQ ID NO: 238596 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggctttaagcaccttctcggtaacttgggcagtac

SEQ ID NO: 238597 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttctagacttctcggtaacttgggcagttacc

SEQ ID NO: 238598 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttctaagcacttctcggtaacttggcagttac

SEQ ID NO: 238599 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttactagcacttctggtaacttgggcagttac

SEQ ID NO: 238600 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttactagcacttctcggtaacttgggcagtta

SEQ ID NO: 238601 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcctttaagcacttctcggtaacttgggcagtta

SEQ ID NO: 238602 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcgcttctcggtaacttgggcagttac

SEQ ID NO: 238603 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaactttggcagttac

SEQ ID NO: 238604 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacttgggcagctac

SEQ ID NO: 238605 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacttggcagttacc

SEQ ID NO: 238606 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacttgagctgttac

SEQ ID NO: 238607 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggtaacttaagcagttac

SEQ ID NO: 238608 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttccgtgatacttgggcagttac

SEQ ID NO: 238609 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcactctcggtaaccttggcgagttac

SEQ ID NO: 238610 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcaccttctcggtaacttggcagttac

SEQ ID NO: 238611 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttagactcaagcttcctgtagttgggcactac

SEQ ID NO: 238612 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttactacgcacttctcgtacttgggcagttac

SEQ ID NO: 238613 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagtcgacttctcggtaacttggcagttac

SEQ ID NO: 238614 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctattcctcggtacttgggcgagttac

SEQ ID NO: 238615 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctcggcgacttgggcagttac

SEQ ID NO: 238616 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttctccgtaacttgggcagttac

SEQ ID NO: 238617 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttcctcggtacttggcgagttac

SEQ ID NO: 238618 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcgtattcgtcgtacttgggcgagttac

SEQ ID NO: 238619 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcgacttctcggtaacttgggcagttac

SEQ ID NO: 238620 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagccacttctccggtaacttggcagttac

SEQ ID NO: 238621 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcagttctcggttaacttgggcagttac

SEQ ID NO: 238622 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttcttggtaacttgggcgagttac

SEQ ID NO: 238623 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaactttgggcagttgc

SEQ ID NO: 238624 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttgtagcagttac

SEQ ID NO: 238625 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttgggcagttatc

SEQ ID NO: 238626 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaacttgggacagctta

SEQ ID NO: 238627 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtaaccttggacagttac

SEQ ID NO: 238628 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggcaacttgggcagcttac

SEQ ID NO: 238629 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctccggtaactcgggcagttac

SEQ ID NO: 238630 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttcatcggtaactttggcagttac

SEQ ID NO: 238631 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcaacttctcggtaacttgggcagttac

SEQ ID NO: 238632 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaacgcacttctcggtaacttgggctgttac

SEQ ID NO: 238633 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaacgcactctcggtaacttgggccagttac

SEQ ID NO: 238634 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaaagcactttctgggatacctggcagtaac

SEQ ID NO: 238635 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaaagcacttctcggtaacttgggcagttac

SEQ ID NO: 238636 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttataagcacttctcggtaacttgggcagttac

SEQ ID NO: 238637 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctcttagcacttctcggtaacttgggcagttgac

SEQ ID NO: 238638 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
tatgggcgttaaagcactttctgggataccgtggcagtac

SEQ ID NO: 238639 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcgctttaagcacttctcggtacttgggcagttac

SEQ ID NO: 238640 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggccttttagcacttctcggtaacttgggcagttac

SEQ ID NO: 238641 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcctttagagctacttctcggtacttggcagttac

SEQ ID NO: 238642 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcctttaagctacttctcgtaacttggcgagttac

SEQ ID NO: 238643 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcctttaagctacttctcggtacttggcgagttac

SEQ ID NO: 238644 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcctttaagcacttctcagtaacttgggcagttac

SEQ ID NO: 238645 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcactttaagcacttctcgtaacttgggcagctac

SEQ ID NO: 238646 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggctttaagtcgtgcttcctcgtacttggtgagttac

SEQ ID NO: 238647 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcgttttaagcacttctcggttaacttggcagttac

SEQ ID NO: 238648 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcgcttttaagcacttctcgtaacttgggcagttac

SEQ ID NO: 238649 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggcgctttaagcacttctcgttaacttgggcagttac

SEQ ID NO: 238650 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggagttttaagcacttctcggtaacttgggcagttac

SEQ ID NO: 238651 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgcgccagccacatcaactatgatgacgcttgactgga

SEQ ID NO: 238652 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcttccatccggccatggcatattagaatcgtaaggta

SEQ ID NO: 238653 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgcccagcacatcaactatgatgaccgcttgactgga

SEQ ID NO: 238654 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgccagtcctacatcaactatgatgacgctgactgga

SEQ ID NO: 238655 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgccagtccacatcaactatgatgacgcttgactgga

SEQ ID NO: 238656 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgccagtcactcacttatgactgacgcttgactacga

SEQ ID NO: 238657 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgccagtcacatcacttatgactgacgcttgctacga

SEQ ID NO: 238658 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgccagcctacatcaactatgatgacgcttgactgga

SEQ ID NO: 238659 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgccagccacatcaacttatgatgacgcttgactgga

SEQ ID NO: 238660 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgccagccacatcaactatgatgacgcttgacctgga

SEQ ID NO: 238661 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatcgcagtctacatcaactatgagtgacgcttgactgga

SEQ ID NO: 238662 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatagggcttttaagcacttctcgtaacttgggcagttac

SEQ ID NO: 238663 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataggctttaagcacttcatcggtaacttgggcagttac

SEQ ID NO: 238664 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatacgccagccacatcaactatgatgacgcttgactgga

SEQ ID NO: 238665 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagctgtcttttaatctcggcagtagtgctcatgggc

SEQ ID NO: 238666 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagctgtcttttaatctcggcagagtgctcattgagc

SEQ ID NO: 238667 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgttttttaatctcggcagagtgctcatgagc

SEQ ID NO: 238668 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttgatctcggcagagtgctcataagc

SEQ ID NO: 238669 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcggagtgctcgtgagc

SEQ ID NO: 238670 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcagagtgctcatgcac

SEQ ID NO: 238671 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaatctcggcaaagtgctcatgggc

SEQ ID NO: 238672 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtcttttaacctcggcagagtgctcatgagc

SEQ ID NO: 238673 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtctttaatctcggccagagtgctcatgagc

SEQ ID NO: 238674 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtctttaatctccgcagagtcgctcatgagc

SEQ ID NO: 238675 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataagcctgtctttaatcatcggcagagtgctcatgagc

SEQ ID NO: 238676 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataacgctgtctttaatctcggcagagtcgctcatgagc

SEQ ID NO: 238677 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tataacgcctgtctttcaatctcgcagagtgctcatgagc

SEQ ID NO: 238678 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcggtccgtactttcaggcgctatcctgatcacccgt

SEQ ID NO: 238679 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgccagccacatcaactatgatgacgcttgactgga

SEQ ID NO: 238680 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgatccgtactttcaggcgctatcctgatcactcga

SEQ ID NO: 238681 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagtcgatccgtactttcaggcgctatcctgatcacccgg

SEQ ID NO: 238682 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taggggcttttgagcacttctcggtaacttgggcagttac

SEQ ID NO: 238683 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taggggcctttaagcacttctcggtaacttgggcagttac

SEQ ID NO: 238684 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagggctttagctacttctcggtacttggtcgtgagttac

SEQ ID NO: 238685 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taggcttaaacgctactttctcgggatacctggcagtaac

SEQ ID NO: 238686 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagctatccgttgtccgtcctcttgtggtattgcgcatgc

SEQ ID NO: 238687 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagcggttttaagcacttctcggtaacttgggcagttacc

SEQ ID NO: 238688 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tagccgatccgtactttcaggcgctatcctgatcacccga

SEQ ID NO: 238689 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactggtgcgcctcggattcctcttcatgcaattgcaaac

SEQ ID NO: 238690 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatctgtttgtccgtcctcttgtggtattgcgcatgc

SEQ ID NO: 238691 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatcgcttgtccgtcctcttgtcggtattgcgcatgc

SEQ ID NO: 238692 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccttttgtccgtcctcttgtggtattgcgcatgc

SEQ ID NO: 238693 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttgtccgtcttctcgtggtattgcgcatgc

SEQ ID NO: 238694 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttgtccgtcctcttgtggtgttgcgcatgc

SEQ ID NO: 238695 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttgtccgtcctcttgtggtattgtgcatgc

SEQ ID NO: 238696 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttgtccgtcctcttgtggtattgcgtatgc

SEQ ID NO: 238697 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttgtccgtcctcttgtggtattgcacatgc

SEQ ID NO: 238698 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttgtccgtcctcttgtggtactgcgcatgc

SEQ ID NO: 238699 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttgtccgtcctcttgtagtattgcgcatgc

SEQ ID NO: 238700 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttgtccgtcctcttatggtattgcgcatgc

SEQ ID NO: 238701 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttgtccgtcctctcgtggtattgcgaatgc

SEQ ID NO: 238702 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttgtccgtcctcatgtggtattgcgcatgc

SEQ ID NO: 238703 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgtttgtcccgtcctctgtggtattgcgcatgc

SEQ ID NO: 238704 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgttcgtccgtcctcttgtggtattgcgcacgc

SEQ ID NO: 238705 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgcttgtccgtcctcttgtggtgttgcgcatgc

SEQ ID NO: 238706 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccgcttgcccgtcctcttgtggtattgcgcatgc

SEQ ID NO: 238707 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccccatcgagcgatcgtcgtaatactgcttccag

SEQ ID NO: 238708 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactatccatttgtccgtcctctcgtggtattgcgcatgc

SEQ ID NO: 238709 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactacccgtttgtccgtcctcttgtggtattgcgcatgc

SEQ ID NO: 238710 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactacccccatcgagcgagtctactctcccatctacggg

SEQ ID NO: 238711 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactacccccatcgagcgagtctactctcccatcgacggg

SEQ ID NO: 238712 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactacccccatcgagcgagtctactctcccaccaacggg

SEQ ID NO: 238713 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactaccccatcgagcgagtctactctcccaatcaacggg

SEQ ID NO: 238714 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactaccccatcgagccgagtctactctcccattaacggg

SEQ ID NO: 238715 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactaccccatccgagcgagtctactctcccatcaacggg

SEQ ID NO: 238716 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactaccccactcgagcgagtctactcgtccatcaacggg

SEQ ID NO: 238717 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacgtgcagcctcgaattggcgccaccgctctacactgat

SEQ ID NO: 238718 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacgtcgcagcactatctccgttttaagaccgcaagttta

SEQ ID NO: 238719 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacgtaccccatcgagcgagtctactctcccatcaacggg

SEQ ID NO: 238720 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacggggctttaagcactctcggtaacttagggcagttac

SEQ ID NO: 238721 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacgggctttaggctacttctcggtaacttgggcagttac

SEQ ID NO: 238722 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacgctcgcagcactatctccgtttaagaccgcaagttca

SEQ ID NO: 238723 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgggactggaggcgtccttggtggactaccaccttat

SEQ ID NO: 238724 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccggcactggaggcgtccttggtgggctaccaccttat

SEQ ID NO: 238725 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccggcactggaggcgtccctggtgggctaccaccttat

SEQ ID NO: 238726 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccggcactggagcgatccctggtggactaccaccttat

SEQ ID NO: 238727 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccggcaccggaggcgtccctggtggactaccaccttat

SEQ ID NO: 238728 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgtacgtgtgtcagttgctg

SEQ ID NO: 238729 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacgacgtgtatcagatggctg

SEQ ID NO: 238730 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcatcatcggacacaacgtgtatcagttggctg

SEQ ID NO: 238731 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcacttcatcggcacgtacgtgtatcagtgctg

SEQ ID NO: 238732 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgcctcaccaccggacacgacgtgtatcagttggctg

SEQ ID NO: 238733 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccgacactggaggcgtccctggtggactaccaccttat

SEQ ID NO: 238734 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccagtacctccaaaagcattaggccaacccttgaactg

SEQ ID NO: 238735 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taccacccccatcgagcgagtctactctcccatcaacggg

SEQ ID NO: 238736 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacataacgccttggaatgcaacgttacatattttccccg

SEQ ID NO: 238737 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tacagcggccctcgtgttggactaccaacttgcagagcgg

SEQ ID NO: 238738 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taatctggtacctatcatgcgctatcatggcggctaggac

SEQ ID NO: 238739 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taatcgccagtcacatcaactatgatgacgcttgactgga

SEQ ID NO: 238740 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaggggctttaagcacttctcggtagcttgggcagttac

SEQ ID NO: 238741 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taagcctcgatcctcgcaccgcacgcgatcccaatgtttg

SEQ ID NO: 238742 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taagagtgcacagtactgcctcgatcctccgtggcttaag

SEQ ID NO: 238743 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaccggggctcgcctcgagctagctacctccattgtctg

SEQ ID NO: 238744 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaccggggcccgcctcaagctagctacctctattgtctg

SEQ ID NO: 238745 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaccggggcccgcctcaagctagctacctccgttgtctg

SEQ ID NO: 238746 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaccggggcccgcctcaagctagctacctccattttctg

SEQ ID NO: 238747 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaccggggcccgcctcaagctagctacctccattgtcta

SEQ ID NO: 238748 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaccggggcccgcctcaagctagctacctccattgtccg

SEQ ID NO: 238749 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaccggggcccgcctcaagctagctacctccattgtcag

SEQ ID NO: 238750 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaccggggcccgcctcaagctagccacctccattgtctg

SEQ ID NO: 238751 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaccggggcccgcctcaagctagcaacctccattgtctg

SEQ ID NO: 238752 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaccggggcccgccccaagctagctacctccattgtctg

SEQ ID NO: 238753 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaccgggccgcctcaaggctagtctacctccattgtctg

SEQ ID NO: 238754 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaccgggcccgcctcaagctagctacctccacttgtctg

SEQ ID NO: 238755 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
taaccgggcccgcctcaagctagctaccgtccattgtctg

SEQ ID NO: 238756 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtttatggtacgcctcgattccgcccatacatgcatgtaa

SEQ ID NO: 238757 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtttaagcgcaccagctaatagcatggaccccttaaactg

SEQ ID NO: 238758 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtttaagcgcaccacgctaatacgcatggccccttaactg

SEQ ID NO: 238759 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggttcgaaccggtaagcatg

SEQ ID NO: 238760 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggttcgaaccagtatgcata

SEQ ID NO: 238761 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtcctcatggtccgaaccggtgtgcatg

SEQ ID NO: 238762 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctctgtccccatggttcgaaccggtatgcgtg

SEQ ID NO: 238763 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttctcgcctccgtcctcatggttcgaaccggtacgcatg

SEQ ID NO: 238764 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gttcacgcctctgtcctcatggttcgaaccggtatgcatg

SEQ ID NO: 238765 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgtttgtgttaaatccgcctcgcacctcaaacacgaata

SEQ ID NO: 238766 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
gtgtccatgacgtcttctggcactatccagttgacgctca

SEQ ID NO: 238767 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgtccatgacgcttctggcatctatccagttgacgctca

SEQ ID NO: 238768 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgtacctccggtcctccttacccgcttttcgcccgcata

SEQ ID NO: 238769 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtggtccatgagcttctggcactactccagttgacgctca

SEQ ID NO: 238770 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtggtccatcgagcttctggcactatccagttgacgctca

SEQ ID NO: 238771 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtggtagaatctcggttcgctccgtccgcccaaatgcccg

SEQ ID NO: 238772 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgcgaaacgctatttctggaagccgcatctcgagctgaa

SEQ ID NO: 238773 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtgatcacataaagccggcttgctcgcctcggtcctccat

SEQ ID NO: 238774 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcttatccggctagacgtctttcgtgcactatcacgatt

SEQ ID NO: 238775 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtctccgtctaacacgtgcactatcacggctttagttaga

SEQ ID NO: 238776 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtctatggtacgcctcgattctgcccatacatgcatgtaa

SEQ ID NO: 238777 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtctatccgtttgtccgtcctcttgtggtattgcgcatgc

SEQ ID NO: 238778 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtctatccggcaggacgtctttcgtgcacctatcacgatt

SEQ ID NO: 238779 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtctaggcttcacgcacgcggattgccacccgaactgggt

SEQ ID NO: 238780 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtgacttaccacctgacatcgcggggaactaagtgtt

SEQ ID NO: 238781 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacattgcggggaactaatggtt

SEQ ID NO: 238782 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacatcgcggggaactattggtt

SEQ ID NO: 238783 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacatcgcggggaacgaatggtt

SEQ ID NO: 238784 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttaccaccctgacatcccggggaactaatggtt

SEQ ID NO: 238785 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgtacttacaccctgacatcgcggggaacttaatggtt

SEQ ID NO: 238786 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcggtttcttctctgactacatgagattaataaacgcgc

SEQ ID NO: 238787 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgggaacgcctcgatcctcgcataatatgatacgtctg

SEQ ID NO: 238788 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcggaacgcctcgattcctcgcataatatgatacgtctg

SEQ ID NO: 238789 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcggaacgcctcgatcctcgacataatatgatacgtctg

SEQ ID NO: 238790 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgatggtacgcctcgattccgcccatacatgcatgtaa

SEQ ID NO: 238791 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgaggatagtcgtcccgaactatcgcgaataagactaa

SEQ ID NO: 238792 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgacggtcactagtgacgcctcgtcctcttttcgtctg

SEQ ID NO: 238793 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgaatcgcctcgactcactacataatgtgatacgtctg

SEQ ID NO: 238794 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgaacgcctcgatcctcgacataatatgatacgtctga

SEQ ID NO: 238795 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcgaacgcctcgactcctcgacataatatgatacgtctg

SEQ ID NO: 238796 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcctgaacgcctcggtcctcgcataatatgatacgtctg

SEQ ID NO: 238797 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcctcgcctctgtcctcatggttcgaaccggtatacatg

SEQ ID NO: 238798 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcctcgccgccgtcctcatggttcgaaccggtatgcatg

SEQ ID NO: 238799 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcctcgacctgattttggccgtccgtgcgcacatcggtt

SEQ ID NO: 238800 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcctcatgctgtgctctcggatctaacctcccttgcaga

SEQ ID NO: 238801 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgtggtacgcctcgattccgcccttacatgcatgtaa

SEQ ID NO: 238802 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgtcgtcccgttttggatgttacgttgaatctcgttc

SEQ ID NO: 238803 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgtcctcgtataattcaggatggcttattatctagct

SEQ ID NO: 238804 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggtacgccccgatcctcgcataatatgatacgtctg

SEQ ID NO: 238805 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgggacgcctcgattctcgcataatatgatacgtctg

SEQ ID NO: 238806 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgggacgcctcgatcctcgcaaaatatgatacgtctg

SEQ ID NO: 238807 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgggaacgcctcgatcctcgcatatatgatacgtctg

SEQ ID NO: 238808 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggagcgcttcgatcctcgcataatatgatacgtctg

SEQ ID NO: 238809 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggagcgcctcgatcctcgcataatatgatacgtcgg

SEQ ID NO: 238810 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaccgcctcgatcctcgcacaatatgatacgtctg

SEQ ID NO: 238811 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgtctcgatcctcgcataatataatacgtctg

SEQ ID NO: 238812 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgccttgatcctcgcataatatgttacgtctg

SEQ ID NO: 238813 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgccttcgatctcgcataatatgatacgtctg

SEQ ID NO: 238814 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgccttcgatcctcgcatatatgatacgtctg

SEQ ID NO: 238815 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcgtaaaatgatacgtctg

SEQ ID NO: 238816 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcatatatgatgacgtctg

SEQ ID NO: 238817 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcatatataactacgtctg

SEQ ID NO: 238818 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatttgatacgtccg

SEQ ID NO: 238819 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatggtacggctg

SEQ ID NO: 238820 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatatggtacgcctg

SEQ ID NO: 238821 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataatataatgcgtctg

SEQ ID NO: 238822 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataataggatacgtctg

SEQ ID NO: 238823 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcataataaggtacgtctg

SEQ ID NO: 238824 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcacgatatgatacgtctg

SEQ ID NO: 238825 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcacaatgtgatacgtctg

SEQ ID NO: 238826 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcacaatatgatacgtttg

SEQ ID NO: 238827 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatcctcgcacaacatgatacgtctg

SEQ ID NO: 238828 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatccacgcataatatgataggtctg

SEQ ID NO: 238829 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctcgatccacgcataataagatacgtctg

SEQ ID NO: 238830 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctccatcctcgcataatatgatacgtctg

SEQ ID NO: 238831 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgcctagatcctcgcataatatgatacgtctg

SEQ ID NO: 238832 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaacgccgcgatcctcgcataatatgatacgtctg

SEQ ID NO: 238833 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccggaaagcctcgatcctcgcataatatggtacgtctg

SEQ ID NO: 238834 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgatacgcctcgatcctcgcataatatgatacgtctg

SEQ ID NO: 238835 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaccgcctcgactcctcgcataatatgatacgtctg

SEQ ID NO: 238836 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaagcgcctcgatccctcgcacatatgatacgtctg

SEQ ID NO: 238837 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacggcctcgatcctcgcatgatatgatacgtctg

SEQ ID NO: 238838 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgcctcgtccgtcactatcattaacttagttga

SEQ ID NO: 238839 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgcctcgattcctcgcataatatggtacgtctg

SEQ ID NO: 238840 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgcctcgatcctcgccataatatgatacgtctg

SEQ ID NO: 238841 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgcctcgatcctcgcataactatgatacgtctg

SEQ ID NO: 238842 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgcctcgactcctcgcatatatgatacgtctgt

SEQ ID NO: 238843 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgaacgccccgattcctcgcataatatgatacgtctg

SEQ ID NO: 238844 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcccgaacgcctcgatcctcgcataatatgatacgtctg

SEQ ID NO: 238845 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcccatggtacgcctcgattccgccatacatgcatgtaa

SEQ ID NO: 238846 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccattggtacgcctcaagctagctacctccattgtctg

SEQ ID NO: 238847 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatgtacgcctcgattccgcccatacatgcatgtcga

SEQ ID NO: 238848 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatgtacgcctcgattccacccatacattgcatgtaa

SEQ ID NO: 238849 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatgtacgcctcgacttccgccataccatgcatgtaa

SEQ ID NO: 238850 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtgcgcctcgattccgcccgtacatgcatgtaa

SEQ ID NO: 238851 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtatgcctcgattccgccattacatgcatgtaa

SEQ ID NO: 238852 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgtctcgattccgtccatacatgcatgtaa

SEQ ID NO: 238853 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgccttgattccgcccatacatgcatgtga

SEQ ID NO: 238854 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcggttctgcccatacatgcatgtaa

SEQ ID NO: 238855 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcggttccgcccatacatgcgtgtaa

SEQ ID NO: 238856 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgatttccgccgtacatgcatgtaa

SEQ ID NO: 238857 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgatttccgccatgcatgcatgtaa

SEQ ID NO: 238858 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgtccatacatgcatgtag

SEQ ID NO: 238859 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgctcacacatgcatgtaa

SEQ ID NO: 238860 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcgcatacatgcatgtaa

SEQ ID NO: 238861 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcctatacctgcatgtaa

SEQ ID NO: 238862 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcctatacatgcatgcaa

SEQ ID NO: 238863 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccttacatggatgtaa

SEQ ID NO: 238864 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccttacatgcagttac

SEQ ID NO: 238865 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccgtacatgcgtgtaa

SEQ ID NO: 238866 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccgcacatgcatgtaa

SEQ ID NO: 238867 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatgcatacatgtaa

SEQ ID NO: 238868 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatgtatgcaa

SEQ ID NO: 238869 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatgcctgtaa

SEQ ID NO: 238870 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatgcatatta

SEQ ID NO: 238871 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatgcacgtag

SEQ ID NO: 238872 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccatacatgcacgcaa

SEQ ID NO: 238873 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgcccacacatgcatgtga

SEQ ID NO: 238874 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgccatacgatgcatgtaa

SEQ ID NO: 238875 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgccatacattgcatgtga

SEQ ID NO: 238876 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgccatacatgccatgtaa

SEQ ID NO: 238877 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccgccatacatgcagtgtaa

SEQ ID NO: 238878 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccccgcatacatgcatgtaa

SEQ ID NO: 238879 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccccccacacatgcatgtaa

SEQ ID NO: 238880 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccatccatacatgcatgtaa

SEQ ID NO: 238881 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattccacccgtacatgcatgtaa

SEQ ID NO: 238882 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgattacgcccatacatgcatgtaa

SEQ ID NO: 238883 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgatcccgcccatacgtgcatgtaa

SEQ ID NO: 238884 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgactccgcccgtacatgcatgtaa

SEQ ID NO: 238885 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgactccgcccatacgtgcatgtaa

SEQ ID NO: 238886 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgcctcgactccgcccatacatgcatatta

SEQ ID NO: 238887 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgccgcgattccgcccatacatgcatgtaa

SEQ ID NO: 238888 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgccccgattccgcccatacatgcatgtga

SEQ ID NO: 238889 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacagcctcgattccgccatacatgcatgtaa

SEQ ID NO: 238890 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggcatgcctcgattccgcccatacatgcatgtaa

SEQ ID NO: 238891 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggcacgcctcgattccacccatacatgcatgtaa

SEQ ID NO: 238892 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggacgcctcgattcgcctacattgccattggtaa

SEQ ID NO: 238893 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatagtacgcctcgattccgcccatgcatgcatgtaa

SEQ ID NO: 238894 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
gtccaggtacgcctcgattccgcccacacattgcatgtaa

SEQ ID NO: 238895 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccacggtacgcctcgattccgcccgtacatgcatgtaa

SEQ ID NO: 238896 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccacggtacgcctcgattccgcccatacatgcatgtga

SEQ ID NO: 238897 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccacggtacgcctcgattccgcccacacatgcatgtaa

SEQ ID NO: 238898 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcatggtacgctcgatttcgcccatcacatgcattgtaa

SEQ ID NO: 238899 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcatggggcttttaagcactctcgtaacttggcagttac

SEQ ID NO: 238900 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcatggggctttaagcacttctcggtacttgggcagtac

SEQ ID NO: 238901 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcaggaacgcctcgatcctcgcataatgtgatacgtctg

SEQ ID NO: 238902 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcaggaacgcctcgatcctcgcataatatgatacgtctg

SEQ ID NO: 238903 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatggggcttttaagcacttctcggtacttggcagttac

SEQ ID NO: 238904 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatctttatccgcccctctgccatggtgggcctacatcg

SEQ ID NO: 238905 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtatcgccagccacatcaactatgatgacgcttgactgga

SEQ ID NO: 238906 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaggtgcgtaccctctttagccgcctctgaagattgagt

SEQ ID NO: 238907 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtactccggatgagccacctcgcatccctccgttcgtctg

SEQ ID NO: 238908 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtacaggcatgcagtactcgcctcgacacaactatggcca

SEQ ID NO: 238909 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaataaccttccgttactcgcctcgggctagtgtgcgca

SEQ ID NO: 238910 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaataaccttccgttactcgcctcgggcaagtgtgtgca

SEQ ID NO: 238911 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaataaccttccgttactcgcctcggcaagtgtgcgcaa

SEQ ID NO: 238912 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaataaccttccgttacccgcctcgggcaagtgtgcgca

SEQ ID NO: 238913 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaccgggccgcccttcacttaagccttactcaatgctg

SEQ ID NO: 238914 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatggtacgcctcgattccgcccatacatgcatgtaa

SEQ ID NO: 238915 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattcacgttggatcgccttgctcctcttagtctg

SEQ ID NO: 238916 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtaaatattcacgttgaatcgccttgcccctcttagtctg

SEQ ID NO: 238917 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtgcggtattcgaggcgttgtacgctattacattgaagc

SEQ ID NO: 238918 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtgatcctcccccccgcctcgaagatttgtgcacgtatc

SEQ ID NO: 238919 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggtccctgtgtcttgatgccacagacgttcagtgcccccg

SEQ ID NO: 238920 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gggtacctgatatgctgttatattttttggaacctctctt

SEQ ID NO: 238921 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggggtttcttctcctgactacatgggattaataaacgcgc

SEQ ID NO: 238922 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggctcgttgtgggttgatttgcgcgtactagtgccatcga

SEQ ID NO: 238923 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcggtttcttctcctgactacatagattaataaacgcgc

SEQ ID NO: 238924 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcggccgactcgcctcgatgctccatgtaacgttacgaa

SEQ ID NO: 238925 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcggccgactcgcctcgatcctccacgtaacgttacgaa

SEQ ID NO: 238926 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcccgttgtgagttgatttgcgcgtactagtgccatcga

SEQ ID NO: 238927 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggcacgcagaaagtcacacgagctatcgtgacgctggctt

SEQ ID NO: 238928 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggatcacgctgcctttgtttaaggcctttatacaaacgca

SEQ ID NO: 238929 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ggacatggtacgcctcgattccgcccatacatgcatgtaa

SEQ ID NO: 238930 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctcttatcggcaggacgtctttcgtgccactatcacgat

SEQ ID NO: 238931 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctcttatccggcggacgtctttacgtgcactatcacgat

SEQ ID NO: 238932 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctcacgctgccctttgtttaaggcctttatacaaacgca

SEQ ID NO: 238933 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgtacgcggattgtacccgaactgggtt

SEQ ID NO: 238934 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggctttcacgcacgcggatctgtacccgaactggtt

SEQ ID NO: 238935 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggcttcacgcacgccggattgtacccgaactgggtt

SEQ ID NO: 238936 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaggccttcacgcacgcggactgtacccgaactgggtt

SEQ ID NO: 238937 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccttcgtctagcggcgctctgtggtaagactctact

SEQ ID NO: 238938 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gctaccatcgtctagcgagtcacccttagttcatcaaggc

SEQ ID NO: 238939 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttgcttctcctgactacgtgagattaataaacgcgc

SEQ ID NO: 238940 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttgcttctcctgactacatgagattgataaacgcgc

SEQ ID NO: 238941 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttgcttatcctgactacatgagattaataaacgcgc

SEQ ID NO: 238942 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttgctctcctgactaccatgagattaataaacgcgc

SEQ ID NO: 238943 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttctttctcctgactacatgagattaataaacgcgc

SEQ ID NO: 238944 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttcttctcctgactacattgaggttaataaacgcgc

SEQ ID NO: 238945 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttcttctcctgactacatgagattaataacagcgac

SEQ ID NO: 238946 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttcttctccctgactacatgagattaataaacgcgc

SEQ ID NO: 238947 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtttctctcctgactacattgagattaataaaccgcgc

SEQ ID NO: 238948 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttgtggcactattcacagacttagctactatcgcggt

SEQ ID NO: 238949 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttgtgcactattcacagacttagccttaatctgcggt

SEQ ID NO: 238950 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttgtgacactattcacagacttagcttaatctgcggt

SEQ ID NO: 238951 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttcttctccttgactacatgagattaataaaccgcgc

SEQ ID NO: 238952 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttcttctccttgactacatgagattaagtaaacgcgc

SEQ ID NO: 238953 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttcttctcctgactcacatgagattaatagatcgcgc

SEQ ID NO: 238954 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgttcactctctgactacatgagattaataaaccgcgtc

SEQ ID NO: 238955 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtgttcttctcctgactacatgagattaataaacgcgc

SEQ ID NO: 238956 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtgatcagctagtcgtgctttgtccactatgacattca

SEQ ID NO: 238957 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgtcttctccttcgactcacatgagattaataaacgcgc

SEQ ID NO: 238958 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttttcttctcctgactacatgagattaataacgcgc

SEQ ID NO: 238959 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttttcttctcctgactacatgagattaataaacgcg

SEQ ID NO: 238960 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttttcttctcctgactacatagattaataaacgcgc

SEQ ID NO: 238961 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttgttctcctgactacatgagattaataaacgcgc

SEQ ID NO: 238962 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttgcttctctgactgcatgagattaataaacgcgc

SEQ ID NO: 238963 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttgcttctcctgactacatgagattataaacgcgc

SEQ ID NO: 238964 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttgcttctcctgactacatgagattaataaacgcg

SEQ ID NO: 238965 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctccttactacatgagattaataaacgcgc

SEQ ID NO: 238966 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactagatgagattaataaacgcgc

SEQ ID NO: 238967 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacattagattaataaacgcgc

SEQ ID NO: 238968 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgtgattaataaacgcgc

SEQ ID NO: 238969 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatggagattaataacgcgc

SEQ ID NO: 238970 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagtttaataaacgcgc

SEQ ID NO: 238971 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagcttaataaacgcgc

SEQ ID NO: 238972 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattagtaaatgcgc

SEQ ID NO: 238973 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattagcaaacgcgc

SEQ ID NO: 238974 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattaatgaacgtgc

SEQ ID NO: 238975 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattaataaactcgc

SEQ ID NO: 238976 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagattaataaacgtgt

SEQ ID NO: 238977 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgaaattaataaacgcgc

SEQ ID NO: 238978 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacataagattaatagacgcgc

SEQ ID NO: 238979 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgaccacatgagattaataagcgcgc

SEQ ID NO: 238980 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttcacctgactacatgagattaataaacgcgc

SEQ ID NO: 238981 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttctctccctgactacatgagattaataaacgcgc

SEQ ID NO: 238982 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttctactcctgactacatgagattaataaacgcgc

SEQ ID NO: 238983 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcgtctcctgactacatgagattaataaacgcgc

SEQ ID NO: 238984 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcactctctgactacatgagattaactaaacgcg

SEQ ID NO: 238985 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttattctcctgactacatgagattaataaacgcgc

SEQ ID NO: 238986 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttcttctcctgactatcatgagattaataaacgcgc

SEQ ID NO: 238987 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttcttctcctactacatgagattaagttaaacgcgc

SEQ ID NO: 238988 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttcttctacctgactacatgagattaataaacgcgc

SEQ ID NO: 238989 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttcttactcctgactacatgagattaataaacgcgc

SEQ ID NO: 238990 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttccttctcctgactacatgagattaataaacgcac

SEQ ID NO: 238991 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttccttctcctgactacatgagatcaataaacgcgc

SEQ ID NO: 238992 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttccttctcccgactacatgagattaataaacgcgc

SEQ ID NO: 238993 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttcactctctgactacatgagattaataaccgcgtc

SEQ ID NO: 238994 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggttacttctcctgactacatgagattaataaacgcgc

SEQ ID NO: 238995 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtctcttctcctgactacataagattaataaacgcac

SEQ ID NO: 238996 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtatcttctcctgactacatgaggttaataaacgcgc

SEQ ID NO: 238997 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggcttcttctcctgactacataagattaataaacgcgc

SEQ ID NO: 238998 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggctatcccgacgccatcgccatgcagccgataaatat

SEQ ID NO: 238999 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggattcttctcctcgactacatgagattataaacgcgc

SEQ ID NO: 239000 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggattcttctcctcgactacatgagattaataacgcgc

SEQ ID NO: 239001 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggattctctctctgactacatgagattaataaacgcgc

SEQ ID NO: 239002 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggattcgcttcgctcactacatgaagattataacgcgc

SEQ ID NO: 239003 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgcccgggactgcctcgattcctccgtctggtgtctgta

SEQ ID NO: 239004 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgccacgtctctgtacctctcctcggattcgtcctccaa

SEQ ID NO: 239005 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgcaccccgatagtcgtcttcactggaccacccgtgtta

SEQ ID NO: 239006 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgcaccccgatagtcatcttcactggaccacccgtgtta

SEQ ID NO: 239007 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgcaccccgatagtcatcttcactggaccacccgtatta

SEQ ID NO: 239008 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgcacagctcacttcgtctttgatcgaccacgctcataa

SEQ ID NO: 239009 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgattcttctcctgactacatgagattaactaaacgcgc

SEQ ID NO: 239010 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgatccttcctcagcttccgcggtgcaggatttgcacgt

SEQ ID NO: 239011 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcgatccttcctcagcctccgcggtgcaggatttgcacgt

SEQ ID NO: 239012 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcctatggtacgcctcgattccgcccatacatgcatgtaa

SEQ ID NO: 239013 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgtttcttctcctgactacatgagattaataaacgcgc

SEQ ID NO: 239014 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgtacgggtcggttttggtgggggactacccccttgta

SEQ ID NO: 239015 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcattgggtcggttttggtggggactacccccttgta

SEQ ID NO: 239016 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatggtcggttttcggtgggggactacccccttgta

SEQ ID NO: 239017 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttggtggggggactaccccttgta

SEQ ID NO: 239018 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttggtgggggacctaccccttgta

SEQ ID NO: 239019 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttggtggggacctacccccttgta

SEQ ID NO: 239020 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttggtgagggactacccccttgta

SEQ ID NO: 239021 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttggtcggggactacccccttgta

SEQ ID NO: 239022 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
gccgcatgggtcggttttggctggggactacccccttgta

SEQ ID NO: 239023 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttggctggggacgtaccccttgta

SEQ ID NO: 239024 - skipped

SEQ ID NO: 239025 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggtttggtgggggacctacccccttgta

SEQ ID NO: 239026 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggtttcggtgggggactacccccttgta

SEQ ID NO: 239027 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtccggtttggtgggggactacccccttgta

SEQ ID NO: 239028 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgggacgcctcgatcctcgcataatatgatacgtctg

SEQ ID NO: 239029 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgctgcctctattcgtctgatgatgtgcacctcgggt

SEQ ID NO: 239030 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgcctccggagccctcctaagtgcactttaaaccgcg

SEQ ID NO: 239031 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgcctccgaagccctcctaagtgcactttagaccgcg

SEQ ID NO: 239032 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccgcctcccgaagcctcctaagtgcactttaaaccgcg

SEQ ID NO: 239033 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccatggtacgccccgattccgcccatacatgcatgtaa

SEQ ID NO: 239034 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcccatggtacacctcgattccgcccatacatgcatgtaa

SEQ ID NO: 239035 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcatcctcctgacggtctgttgatggctacatcattgttc

SEQ ID NO: 239036 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcagttttcttctcctgactacatgagattaataatgcgc

SEQ ID NO: 239037 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcactattccggtaagtcatcgtttgaccgtttgttgcaa

SEQ ID NO: 239038 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcactatcgtttcgtcgtcctcttgtggtattgcgcatgc

SEQ ID NO: 239039 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcactatcgtttcgctcgtcctcttgtggtattgcgcatg

SEQ ID NO: 239040 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcactatccgtttgtccgtcctcttgtgtattgcgcatgc

SEQ ID NO: 239041 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcacgttcactcggatgtcatcctccaagtgctcgcctcg

SEQ ID NO: 239042 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcaccggggcccgcctcaagctagctacctccattgtctg

SEQ ID NO: 239043 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gattcgccagtcacatcaactatgatgacgcttgactgga

SEQ ID NO: 239044 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatggtccatgagcctctggcactatccagttgacgctca

SEQ ID NO: 239045 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatctactcatcaagcgctatcctgaacaccgatagtacg

SEQ ID NO: 239046 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcggctcgacgttgccgggctaccgccattttttttcg

SEQ ID NO: 239047 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcggcgtcgagtagctctatactgcactatcagtttgt

SEQ ID NO: 239048 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcggcgtcgagtaactctcatactgcactatcagttgt

SEQ ID NO: 239049 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcggagactactccgttggtctgcaggtatcaccacga

SEQ ID NO: 239050 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcgcgctgccctttgtttaaggcctttatacgaacgca

SEQ ID NO: 239051 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcgcactgccctttgtttaaggcctttatacaaacgca

SEQ ID NO: 239052 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcgacgctgccctttgtttaaggcctttatacaacgca

SEQ ID NO: 239053 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatccggacgccctcgatcctcgcatatataatacgtctg

SEQ ID NO: 239054 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatccgacgcctgcctttgttaagcctttatacaaacgca

SEQ ID NO: 239055 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatccatggtacgcctcgattccgcccatacatgctgtaa

SEQ ID NO: 239056 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatccatggtacgcctcgatccgcccatacatgcatgtaa

SEQ ID NO: 239057 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcatcgctgccctttgttaaggcctttatacaaacgca

SEQ ID NO: 239058 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcagcgctgcctttcgttaaggcctttatacaaacgca

SEQ ID NO: 239059 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcagcgctgccttgtttaaggcctttatacaaactgca

SEQ ID NO: 239060 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcagcgctgccttgtttaaggcctttagtacaaacgca

SEQ ID NO: 239061 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgtccttgtttaaggcctttatacaaactgca

SEQ ID NO: 239062 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgcctttgtttaaggcctttatacaaactgca

SEQ ID NO: 239063 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaatgcctttatacaaacgca

SEQ ID NO: 239064 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggcctttatacaaatgca

SEQ ID NO: 239065 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggcctttatacaaacgcc

SEQ ID NO: 239066 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgtttaaggaccttatacaaacgca

SEQ ID NO: 239067 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgttcaagcctttatacaaactgca

SEQ ID NO: 239068 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacgctgccctttgttaaggcctttattacaaacgca

SEQ ID NO: 239069 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatcacactgcctttcgtttaaggcctttatacaaacgca

SEQ ID NO: 239070 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gatatggtcgctttgccgccttgttcactccgtttggtac

SEQ ID NO: 239071 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gataagctcgctaatgccgcctcgtctctaacgtcgtgcg

SEQ ID NO: 239072 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagtcatttgtaatggtgctaaagacaccacccaagcccc

SEQ ID NO: 239073 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagccggggcccgcctcaagctagctacctccattgtctg

SEQ ID NO: 239074 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggattcggcgtactacttggacaggttccttc

SEQ ID NO: 239075 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctggcgtactgtcgtgacaggttccttc

SEQ ID NO: 239076 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctggcgtactacttggacaagttccttc

SEQ ID NO: 239077 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctggcgcactacttggacaggttcctcc

SEQ ID NO: 239078 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcggatctgcgtactacttcggacaggttccttc

SEQ ID NO: 239079 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagatctcgatctggcgtactacttggaacaggttccttc

SEQ ID NO: 239080 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagaactcggatctggcgtactacttggacaggttccttc

SEQ ID NO: 239081 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactatccgtagatccgtcactcactacgcgtatggaatc

SEQ ID NO: 239082 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactacctgcatcgagcgggcgaagacgagagatgctcgt

SEQ ID NO: 239083 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gactacccctatcgagcatggcgtcgccacgtaactggag

SEQ ID NO: 239084 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gacggttccttctcctgactacatgagattaataacacgc

SEQ ID NO: 239085 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gacgggttcttctcctgactacatgagattaataacgcgc

SEQ ID NO: 239086 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gacgcatgggtcggttttggtgggggactacccccttgta

SEQ ID NO: 239087 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gacctactcatcaggcgctatcctgaacaccgatagtacg

SEQ ID NO: 239088 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaccatggtacgcctcgattccccccatacatgcatgtaa

SEQ ID NO: 239089 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaccaggtgcaccatacggaattccgtaatttgggaactg

SEQ ID NO: 239090 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggatcctcgtcctccatactacgtggatttagatt

SEQ ID NO: 239091 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggatcctcgcctccatactatgtggatttagattt

SEQ ID NO: 239092 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggatcctcgcctccatactacgtggatttagtttt

SEQ ID NO: 239093 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaactggatcctcgcctccacactacgtggatttagattt

SEQ ID NO: 239094 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccggtgaccgcctcaagctagctacctccattgtctg

SEQ ID NO: 239095 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccggggaccgcctcaagctagctacctacattgtctg

SEQ ID NO: 239096 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccgggcccgcctcaagtctgctacctccattgtcgtg

SEQ ID NO: 239097 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccgggcccgcctcaagctagctacctaccattgtctg

SEQ ID NO: 239098 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccgggcccgcctcaagcctagctacctccattgtctg

SEQ ID NO: 239099 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaccggatcctcgcctccatactacgtggatttagactt

SEQ ID NO: 239100 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaacggggccccgctcaagctagctacctccattgtctg

SEQ ID NO: 239101 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaaccggggtccgcctcaagctagctacctcattgtctg

SEQ ID NO: 239102 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaaccggggcccgctcaagctagctacctccattgtctg

SEQ ID NO: 239103 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaaacgctagactactaccgtgaactttcccgctcatct

SEQ ID NO: 239104 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gaaaaccgggggccgctcaagctagctacctcattgtctg

SEQ ID NO: 239105 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttctcggtcattgactacaatgttaaaggttgtcgcaat

SEQ ID NO: 239106 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttcctcggatcttcaatatattgccgcctcgcatccgac

SEQ ID NO: 239107 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttcctcggatcttcaacgtattgccgcctcgcatccgac

SEQ ID NO: 239108 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttcctcggatcttcaacatattgccacctcgcatccgac

SEQ ID NO: 239109 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttcctcggatcttcaacatactgccgcctcgcatccgac

SEQ ID NO: 239110 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttcctcggatctgcaacatattgccgcctcgcatccgac

SEQ ID NO: 239111 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttcctcggatctccaacatattgccgcctcgcatccgac

SEQ ID NO: 239112 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttccgatgctcccaggaacccgactcgttaaagtctgta

SEQ ID NO: 239113 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttagtggtttcgccgcccctctgtttagtggccattgga

SEQ ID NO: 239114 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttagtgatttcgccgcccctctgtttaatggccattgga

SEQ ID NO: 239115 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttagtgatttcgccgcccctctgtctagtggccattgga

SEQ ID NO: 239116 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttagtgattacgccgcccctctgtttagtggccattgga

SEQ ID NO: 239117 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttagtaatttcgccgcccctctgtttagtggccattgga

SEQ ID NO: 239118 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cttacgtgatttcgccgcccctctgtctagtggccattga

SEQ ID NO: 239119 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgttttttctcggataactggagccgcctcacctaccaa

SEQ ID NO: 239120 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctggtccatgagtcttctggcactatccagttgacgctca

SEQ ID NO: 239121 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctggccggattcgccttggtccttccgtgttgcaacagac

SEQ ID NO: 239122 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgctccggatgagccacctcgcattcctccgttcgtctg

SEQ ID NO: 239123 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgctattctcggatctttacttttcgtttcctgtcatcc

SEQ ID NO: 239124 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcctctgctctccctctcggatcgcgtacgcggatatg

SEQ ID NO: 239125 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcctctgctctccccctcggatcgcgtacgtggatatg

SEQ ID NO: 239126 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcctcgatcgtcacgcactgggcccgataatagtattg

SEQ ID NO: 239127 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctgcaccccgattagtcatcttcactggacacccgtgtta

SEQ ID NO: 239128 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttttccggcaggacgtctttcgtgcactatcacgatt

SEQ ID NO: 239129 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttgtccggcatgacgtctttcgtgcactatcacgatt

SEQ ID NO: 239130 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttgtccggcaggacgtctttcgtgcactatcacgact

SEQ ID NO: 239131 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttattcggcaggacgtctttcgtgcgctatcgcgatt

SEQ ID NO: 239132 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatcgggcaggacgtctttcgtgcactgtcacgatt

SEQ ID NO: 239133 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccgtcagacggtcttcttgcgactatcacgatt

SEQ ID NO: 239134 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcgggacgtctttcgtgcactatcacgat

SEQ ID NO: 239135 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcaggcgtctttcgtgcactatcacgatt

SEQ ID NO: 239136 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcaggatcgtcttcgtgcactatcacgat

SEQ ID NO: 239137 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcaggacgtctttctgcgactatcacgat

SEQ ID NO: 239138 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcaggacgtctttcgtgcactatcacatt

SEQ ID NO: 239139 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcaggacgtctttcgcgcacatcacgatt

SEQ ID NO: 239140 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcaggacgtctttcatgcactatcacgat

SEQ ID NO: 239141 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcaggacgtctctcgtgcactatcacgat

SEQ ID NO: 239142 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcaggacgcctttcgtgcactatcacgat

SEQ ID NO: 239143 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcagatcgtccttcgtgcactatcacgat

SEQ ID NO: 239144 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcagacgtctttcgtgcgctatcacgatt

SEQ ID NO: 239145 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggtcagacgtccttcttgcgactatcacgat

SEQ ID NO: 239146 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggctggacttctttcgtgcactatcacgatt

SEQ ID NO: 239147 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggctggacgtctttcgtgcactatcacgatc

SEQ ID NO: 239148 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcggagagtctttcgtgcactatcacgatt

SEQ ID NO: 239149 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcatgacgtctttcgtgcactatcacaatt

SEQ ID NO: 239150 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
ctcttatccggcaggacgtctttcttgcactatcacgatt

SEQ ID NO: 239151 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttctgacactatcacgatt

SEQ ID NO: 239152 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcgactatcacgat

SEQ ID NO: 239153 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgccctatcacgatt

SEQ ID NO: 239154 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactatccacgat

SEQ ID NO: 239155 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactatcaagatt

SEQ ID NO: 239156 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgtgcactaccacgatc

SEQ ID NO: 239157 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttcgcgcactatcacggtt

SEQ ID NO: 239158 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtctttccgtgcactatcacgat

SEQ ID NO: 239159 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtcttccgtgcactatcgcgatt

SEQ ID NO: 239160 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgtccttcgtgcactatcacgact

SEQ ID NO: 239161 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacgcctttcgtgcgccatcacgatt

SEQ ID NO: 239162 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacatctttcgtgcactatcacggtt

SEQ ID NO: 239163 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaggacatcgttcgtgcactatcacgatt

SEQ ID NO: 239164 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcagagcgtctttcgtgcactatcacgatt

SEQ ID NO: 239165 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcagacgtctttcgttgcactatcacgatt

SEQ ID NO: 239166 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcagacgcctttcgttgcactatcacgatt

SEQ ID NO: 239167 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcagaacgtccttcgtgcactatcacgatt

SEQ ID NO: 239168 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaaggcgtctttcgtgcactatcacgatt

SEQ ID NO: 239169 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaagacgtctttcgtgcactatcgcgatt

SEQ ID NO: 239170 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcaagacatctttcgtgcactatcacgatt

SEQ ID NO: 239171 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccgcgagcaggctttcttcgcactatcacgatt

SEQ ID NO: 239172 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccgagcaaggcttccttcgtcactatcacgatt

SEQ ID NO: 239173 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccgacaggacgtctttcgtgcgctatcacgatt

SEQ ID NO: 239174 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccgacaggacgtccttcgtgcactatcacgatt

SEQ ID NO: 239175 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatcccggcaggacgtcttcgtgcactatcacgatt

SEQ ID NO: 239176 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccagcaggacgtctttcgtgcattatcacgatt

SEQ ID NO: 239177 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatcaggcgggacgtctttcgtgcactatcacgatt

SEQ ID NO: 239178 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatcaggcaagacgtctttcgtgcactatcacgatt

SEQ ID NO: 239179 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttagtccgcagatcgtcttcgtgcactcatcacgatt

SEQ ID NO: 239180 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttaccgcgcaggacgtctttcgtgcactatcacgatt

SEQ ID NO: 239181 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttacccggcaggacatctttcgtgcactatcacgatt

SEQ ID NO: 239182 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctgatccggcaggacgtctttcgtgcactatcacgatt

SEQ ID NO: 239183 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctatctgtttgtccgtcctcttgtggtattgcgcatgc

SEQ ID NO: 239184 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctatccgtagatccgtcactcactacgcgtatggaatc

SEQ ID NO: 239185 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctctatccggtcaggacgtctttcgtgcactatcacgatt

SEQ ID NO: 239186 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcgttatcccgcagacgtctttcgtgcactatcacgatt

SEQ ID NO: 239187 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcgtatccggcagaacgtctttcgtgcactatcacgatt

SEQ ID NO: 239188 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcgaaacgctattttctgggaagccgcatctcgagcgaa

SEQ ID NO: 239189 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccttatccgtcaggacgtcttcgtgcactatcacgatt

SEQ ID NO: 239190 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcctatccgttgtccgtcctcttgtggtattgcgcatgc

SEQ ID NO: 239191 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcctatccggcaggacgtctttcgtgcgctatcacgatt

SEQ ID NO: 239192 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcctatccggcaggacgtctttcgtgcactgtcacgatt

SEQ ID NO: 239193 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcctatccggcaggacgtctttcgtgcactattacgatt

SEQ ID NO: 239194 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcctatccggcaggacgtctttcgtgcactatcacgatc

SEQ ID NO: 239195 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcctatccggcaggacgtctttcgtgcactatcacgata

SEQ ID NO: 239196 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcctaccgccgaggacgtctttcgtgcactatcacgatt

SEQ ID NO: 239197 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccggagcgcctcgatcctcgcataatatgatacgtctg

SEQ ID NO: 239198 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccggaacgcctcgatcctcgcacaatatgatacatctg

SEQ ID NO: 239199 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcccgaagcctccccgaggtgccgcctttgatacgtttg

SEQ ID NO: 239200 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccaagacgattgtcgttattgccggactacctgcatct

SEQ ID NO: 239201 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccaagacgattgtcgttattgccggactacccgcattt

SEQ ID NO: 239202 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctccaagacaattgtcgttattgccggactacctgcattt

SEQ ID NO: 239203 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcactatcggcaggactctttcgtgcacctatcacgatt

SEQ ID NO: 239204 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcaaaacatagccgcccctctgaaacgattggccagctt

SEQ ID NO: 239205 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctattatccggcaggacgtctttcgtgcactatcacgatt

SEQ ID NO: 239206 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctagtgatttcgcccgcccctctgtttagtggccattgga

SEQ ID NO: 239207 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctaggctttcacgcacgcggatttgtacccgaactgggtt

SEQ ID NO: 239208 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctaggcccggtttgcccgcctcagttctcctacggttatt

SEQ ID NO: 239209 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctactttctcggatcactaattgccgcatcacgcactccc

SEQ ID NO: 239210 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctactccggatgagccaccacgcattcctccgttcgtctg

SEQ ID NO: 239211 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctactccggataagccacctcgcattcctccgttcgtctg

SEQ ID NO: 239212 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgtcttatcggctaggacggtcttctgcactatcacgatt

SEQ ID NO: 239213 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgtcttatccggcaggacgtcttcgttgcactatcacgat

SEQ ID NO: 239214 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgtctgaccctgttatggactaccatatcagaaaggtact

SEQ ID NO: 239215 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgtcattaatccttgttggactaccaccaaaaacgattaa

SEQ ID NO: 239216 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgtaggtcgcctggtccgccttgatcctctataccgtctg

SEQ ID NO: 239217 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggtttgcttctcctgactacatgagattaataaacgcgc

SEQ ID NO: 239218 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggttcttctcctgactacatgagagttaataaaccacgc

SEQ ID NO: 239219 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggttcgttcttcctgactacatgagattaataaacgcgc

SEQ ID NO: 239220 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggttcactctctgactacatgagattaataaaccgcgtc

SEQ ID NO: 239221 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggctaacgttcatcgagggagcaagaggtctatagacta

SEQ ID NO: 239222 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggctaacgttcatcgagggagcaaatggtctatagacta

SEQ ID NO: 239223 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggctaacgttcatcgagggagcaaaaagtctatagacta

SEQ ID NO: 239224 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggattccgcggtcgccgtttgatgcgctatcatcatgtg

SEQ ID NO: 239225 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggatcccactgttaacagttcctccctcaggtgcgtcaa

SEQ ID NO: 239226 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cggatcccactgttaacagctcctccctcaggtgtgtcaa

SEQ ID NO: 239227 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctgtccgaatcgagcttgagtgtctggttaaacaacga

SEQ ID NO: 239228 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcgtcgagcgagcactttgtgcgatcacaca

SEQ ID NO: 239229 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgagcgggcactttgtgcgatcacaca

SEQ ID NO: 239230 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgagcgagtactttgtgcgatcataca

SEQ ID NO: 239231 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgagcgagcactttgtgcgataacaca

SEQ ID NO: 239232 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgtcatcgagcgagcactctgtgcgatcccaca

SEQ ID NO: 239233 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatctgccatcgagcgagcactttgtgcgatcacaca

SEQ ID NO: 239234 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgttctcttgtggtattgcgcatgc

SEQ ID NO: 239235 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctcttgtggtattgcgcataa

SEQ ID NO: 239236 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctcttgtggcattgcgcatgc

SEQ ID NO: 239237 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctcttgtagtattgcgcatgc

SEQ ID NO: 239238 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctcttatggtattgcgcatgc

SEQ ID NO: 239239 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctctcgaggtattgcgcatgc

SEQ ID NO: 239240 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgccctcttgtggtattgcgcatgc

SEQ ID NO: 239241 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccatcctctcgtggtattgcgcatgc

SEQ ID NO: 239242 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgaccgtcctcttgtggtattgcgcatgc

SEQ ID NO: 239243 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgttgtccgtccttcttgtgtattgcgcatgtc

SEQ ID NO: 239244 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgttcgtccgtcctcttgtggtattgcgcatgc

SEQ ID NO: 239245 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtcttaacgtgttcccttcggacatccatcaa

SEQ ID NO: 239246 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtctgtccgtcctcctgtggtattgcgcatgc

SEQ ID NO: 239247 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtcatcgagcggttcttcgatattatgcaaca

SEQ ID NO: 239248 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtatcgaggagtcttcttttctcaccagaggc

SEQ ID NO: 239249 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtatcgagcgttgtcaacaagcggctaaggct

SEQ ID NO: 239250 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtatcgagcggtcggtccgtgccctacaccca

SEQ ID NO: 239251 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtatcgagcggtcggtccgtgccctaaaacca

SEQ ID NO: 239252 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtaatcgagcttgagtgtctggttaacagcga

SEQ ID NO: 239253 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtaatcgagcttgagtgcctggttaacaacga

SEQ ID NO: 239254 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgagcagtgtgccgtttcggtcg

SEQ ID NO: 239255 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccatcgagcgaacagtgcgccgctttcggtg

SEQ ID NO: 239256 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgccaccgagcgaacagtgtgccgttttcggtg

SEQ ID NO: 239257 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagtcggttcttcgataatatgccaca

SEQ ID NO: 239258 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagtcggttcgtcgataatatgcaaca

SEQ ID NO: 239259 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggttcttcgattatatgcaaca

SEQ ID NO: 239260 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggttcttcgatagtatgcgaca

SEQ ID NO: 239261 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggttcttcgatagtacgcaaca

SEQ ID NO: 239262 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggttcttcgataatgtgcatca

SEQ ID NO: 239263 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggttcttcgataatatgcaacc

SEQ ID NO: 239264 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgcatcgagcgggttcttcaataatatgcaaca

SEQ ID NO: 239265 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgacatcgagagggctacgtcatcaagcgctaa

SEQ ID NO: 239266 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgtgtgtctggttaaacaacga

SEQ ID NO: 239267 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtgtctggttaaataacga

SEQ ID NO: 239268 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagtgtctggttaaacatcga

SEQ ID NO: 239269 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgaatcgagcttgagggtctggttaaacaacga

SEQ ID NO: 239270 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatcccgcatcgagcgggttcttcgataatatcaaca

SEQ ID NO: 239271 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccccatcgagcgatcgtcgtaatactgcttccag

SEQ ID NO: 239272 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgtcttcccggcattaccgcaattgccatacattaata

SEQ ID NO: 239273 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcggttattttataatagcatacgaccctgcgcgctgtt

SEQ ID NO: 239274 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgcagcctcgatcctacacagcatggccatgccgttat

SEQ ID NO: 239275 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgatcatcagttttccaaagtatatatactgttgtctg

SEQ ID NO: 239276 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcgaaacgctattttctgggaagccgcgtctcgagcgaa

SEQ ID NO: 239277 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccttgatcctcgccttcggtgcactgactcgctttctg

SEQ ID NO: 239278 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
cgcctcaggttcccccctaacgcgttagccttccggaatg

SEQ ID NO: 239279 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcctatccgccatcgagcgaacagtgtgccgtttcggtg

SEQ ID NO: 239280 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcctatccgaatcgagcttgagtgtctggttaacaacga

SEQ ID NO: 239281 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccggaagtccctcctcgtcttgatgcactaccatctca

SEQ ID NO: 239282 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccggaagtccctccccgtcttgatgcactatcatctcg

SEQ ID NO: 239283 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccggaagtcccctctcgtcttgatgcactatcatctca

SEQ ID NO: 239284 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccggaagaccctcctcgtcttgatgcactatcatctca

SEQ ID NO: 239285 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgccgaagtcccgtcctcgtcttgatgcactatcatctca

SEQ ID NO: 239286 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcacccccgatagtcatcttcactggaccacccgtgtta

SEQ ID NO: 239287 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcacccccgatagtcatcttcactggacaccccgtgtta

SEQ ID NO: 239288 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcaccccccgatagtcatcttcactggacacccgtgtta

SEQ ID NO: 239289 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgcacaatggattctcagtcctccgccatgctccgcctcg

SEQ ID NO: 239290 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgattatagatcctaccccaactgcgccagaattcgtccg

SEQ ID NO: 239291 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgagttcctccctgtcgcatcgtattactgttctctgctg

SEQ ID NO: 239292 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgagtatggcctgtaaacaatgtctacaccaccgctaccg

SEQ ID NO: 239293 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgactcccttcgttctgcgcagatccaccgcattggatcg

SEQ ID NO: 239294 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgactatccgtttgtcgtcctcttgtggtattgcgcatgc

SEQ ID NO: 239295 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgactatccgtttgtccgtcctctgtggtattgcgcatgc

SEQ ID NO: 239296 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgactatccgtttgctcgtcctctgtggtattgcgcatgc

SEQ ID NO: 239297 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgaattatcagggactaccctgacgcaatattcacacgtt

SEQ ID NO: 239298 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctttccgaccccgtctgttcgcgggctacctcgatcata

SEQ ID NO: 239299 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccttctatagtcgtcggcgtagcacgctattgcttagaag

SEQ ID NO: 239300 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccttccagggcccgatgccgcattatcatcctatgttctg

SEQ ID NO: 239301 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccttccagggccaatgccgcattatcattcctatgttctg

SEQ ID NO: 239302 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccttccaggccaatgtccgcattatcatcctatggttctg

SEQ ID NO: 239303 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccttattcgccgaggacgtctttcgtgcactatcacgatt

SEQ ID NO: 239304 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctgcaccccgatagtcatcttcactggacacccgtgtta

SEQ ID NO: 239305 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgtgtcttccggtaattaccacgtacgtacatgtctg

SEQ ID NO: 239306 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgtatcttccggtaattaccacgtacgtacatgtccg

SEQ ID NO: 239307 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgtatcctccggtaattaccgcgtacgtacatgtctg

SEQ ID NO: 239308 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcggatccttaatttgcaaattaccaccgtgtaacgtt

SEQ ID NO: 239309 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcgatcttccaagtgcacaaccggaccatggatcggac

SEQ ID NO: 239310 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcctcaggttccccctaacgcgttagccttccggaatg

SEQ ID NO: 239311 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cctcacccccgatagtcatctccactggacacccgtgtta

SEQ ID NO: 239312 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtggatcagctagtcgtgctttgtccgctatgacatca

SEQ ID NO: 239313 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgcaccctagatagtctcttcactggacaccgtgtta

SEQ ID NO: 239314 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcggctagtcgtgctttgtccgctatgacattca

SEQ ID NO: 239315 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcagttagtcgtgctttgtccgctatgacattca

SEQ ID NO: 239316 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcagctagtcgtgttttgtccactatgacattca

SEQ ID NO: 239317 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcagctagtcgtgctttgtctgctatgacattca

SEQ ID NO: 239318 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcagctagtcgtgctttgtccgctatgacattta

SEQ ID NO: 239319 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcagctagtcgtgctttgtccgctatgacattcg

SEQ ID NO: 239320 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcagctagtcgtgctttgtccgctatgacattaa

SEQ ID NO: 239321 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcagctagtcgtgctttgtccgctatgacatcca

SEQ ID NO: 239322 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcagctagtcgtgctttgtccgctatgacataca

SEQ ID NO: 239323 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcagctagtcgtgctttgtccactatgacattca

SEQ ID NO: 239324 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcagctagtcgtgctttgaccgctatgacattca

SEQ ID NO: 239325 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtgatcagctagtcgtgcttcgtccgctatgacattca

SEQ ID NO: 239326 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtctcggatctcttgtcgcgttccaaccgttctcccta

SEQ ID NO: 239327 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtcaccctgatagtcatcttcactggacaacccgtgta

SEQ ID NO: 239328 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtcacccgatagtcatcttcacttggaccaccgtgtta

SEQ ID NO: 239329 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtcacccgatagtcatcttcactggaacacccgtgtta

SEQ ID NO: 239330 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtcaccccgatagtcgtcttcgctggacacccgtgtta

SEQ ID NO: 239331 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtcaccccgatagctcatcttcactggacaccgtgtta

SEQ ID NO: 239332 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtaccccgatagtcatcttcactggaccacccgtgtta

SEQ ID NO: 239333 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtaatcagctagtcgtgctttgtccgctatgacattca

SEQ ID NO: 239334 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgtaaatcctccatgcgcgcgcacggatccagtactgca

SEQ ID NO: 239335 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccggtctttattgtcgtctttcgtaggactacctgcatca

SEQ ID NO: 239336 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgggtctttattatcgtctttgtaggactacctgcatca

SEQ ID NO: 239337 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccggctcctcgtcctaacgtatgcatgccttctgtggcca

SEQ ID NO: 239338 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccggcggatcctttcggttcctcttgttccgcggaaactg

SEQ ID NO: 239339 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccggcaccccgatcagccatcttcactgacacccgtgtta

SEQ ID NO: 239340 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccggcaccccgatagtctcttcgctggaccacccgcgtta

SEQ ID NO: 239341 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcttcctctcgtaacacatgtgtactgtatactgcagg

SEQ ID NO: 239342 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgctccccgatagtcatcttcactggaccacccgtgtta

SEQ ID NO: 239343 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcgccccgatggtcatcttcactggaccacccgtgtta

SEQ ID NO: 239344 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcgccccgatagtcgtcttcactggaccacccgtgtta

SEQ ID NO: 239345 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcgcccccgatagtcatcttcactggacacccgtgtta

SEQ ID NO: 239346 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccttgactccaaccccggggtatgtaccataattgca

SEQ ID NO: 239347 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctgggatcactctctacgcgtataaatgctccgtca

SEQ ID NO: 239348 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctctttcctcttattggcctctgcggtgcaccgcga

SEQ ID NO: 239349 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcttcttgcaccgcgcgcgttttattagtcgtctg

SEQ ID NO: 239350 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcttccggtacatgtcctatccttgcgtgcttctg

SEQ ID NO: 239351 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctctgtcctcgtaattacccctcccgtagctgcatg

SEQ ID NO: 239352 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcggtcccgttccaacgcgttagccttccggaatg

SEQ ID NO: 239353 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcggatcgttcccattggtggtacccctattaatg

SEQ ID NO: 239354 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcggatcgttcccaatagtcggtaccctattaatg

SEQ ID NO: 239355 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgctacactccttggacgatcgaccacccaaata

SEQ ID NO: 239356 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgcgtcgtgtacacgaagacctccggagcttttg

SEQ ID NO: 239357 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgcgtcgtgtacacgaagacctccggagagtttg

SEQ ID NO: 239358 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgatatgcagtcatgttctagaacgcttccactg

SEQ ID NO: 239359 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgataagtacaacccgggtagagacagcatgctg

SEQ ID NO: 239360 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaatactgacgtcgtggaaccttctattgctag

SEQ ID NO: 239361 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaactactgacgtcgtggaaccttgattgctag

SEQ ID NO: 239362 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaacactgacgtcgtggaaccttcgactgctag

SEQ ID NO: 239363 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcgaaaccctacgcgcgtacgtgcactttctcttc

SEQ ID NO: 239364 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctccttcctccttgagcatgcttactcgggatactg

SEQ ID NO: 239365 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctccaggttcccctaacgcgttagccttccgggatg

SEQ ID NO: 239366 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctccaacactgacgtcgtggaaccttcgattgctag

SEQ ID NO: 239367 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcatcacacgcgcgtgaaacactgcagctgtaata

SEQ ID NO: 239368 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcagtggctcccgggaccacgtggacatgtttgta

SEQ ID NO: 239369 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcagtcctggtggtaccacaacgcgttgctctttt

SEQ ID NO: 239370 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcagtccgtggatccactttgcacgtgcagtgaca

SEQ ID NO: 239371 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggtttcccctaacgcgttagccttctggaatg

SEQ ID NO: 239372 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggtttcccccaacgcgttagccttccggaatg

SEQ ID NO: 239373 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttccctctaacgcgttagccttccggaatg

SEQ ID NO: 239374 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttccctaacggcgttacgccttccggaatg

SEQ ID NO: 239375 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttccctaacctgcgttagccttccggaatg

SEQ ID NO: 239376 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctagcgcgttagccttccggtaatg

SEQ ID NO: 239377 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctagcgcgttagccttccggaactg

SEQ ID NO: 239378 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgtcgatacgcttccggaatg

SEQ ID NO: 239379 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgttgccgcttccggaatg

SEQ ID NO: 239380 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgttagccttcgtggaatg

SEQ ID NO: 239381 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgttagccttaccggaatg

SEQ ID NO: 239382 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccctaacgcgttagcctcccggaatcg

SEQ ID NO: 239383 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttccccctaacgcgttagcctcccggaatg

SEQ ID NO: 239384 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttccccccaacgcgttagccttccggaatg

SEQ ID NO: 239385 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggttcccccaaacgcgttagccttccggaatg

SEQ ID NO: 239386 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaggctccccctaacgcgttagccttccggaatg

SEQ ID NO: 239387 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcacggtctcccatctgtgcacactgtctagacag

SEQ ID NO: 239388 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcacgcttctccgtgcgcacaccttcttacaactg

SEQ ID NO: 239389 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcctcaatcccatgtacgtacacacgcttcgggtattg

SEQ ID NO: 239390 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccgctcaggttccctaacgcgttagccttccggaatg

SEQ ID NO: 239391 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcccagctcacttcgtctttgatcgaccacgctcataa

SEQ ID NO: 239392 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgccactcaggttccctaacgcgttagccttccggaatg

SEQ ID NO: 239393 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcatgggtcggttttggtggggggactacccccttgta

SEQ ID NO: 239394 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcagccccgatagtcatcttcactggaccaccgtgtta

SEQ ID NO: 239395 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcagccccgatagtcatcttcactggacacccgtgtta

SEQ ID NO: 239396 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcactccgatagtcatcttcgctggaccacccgtgtta

SEQ ID NO: 239397 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacctcgatagtcgtcttcactggaccacccgtgtta

SEQ ID NO: 239398 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacctcgatagtcatcttcgctggaccactcgcgtta

SEQ ID NO: 239399 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccgttacgttcatcttcactggacacctgtgtta

SEQ ID NO: 239400 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccgatcagctcatcttcgctggaccaccgcgtta

SEQ ID NO: 239401 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccgatagtcgtcttcgctggtaccacccgtgtta

SEQ ID NO: 239402 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccgatagtcgatcttccactggacacccgtgtta

SEQ ID NO: 239403 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccgatagtcatcttcactggaccaccctgtgtta

SEQ ID NO: 239404 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccgagtcagtcatcttcgctcggacacccgcgta

SEQ ID NO: 239405 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccgacttagtcatcttcactggacacccgtgtta

SEQ ID NO: 239406 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
ccgcacccgactagtcatctttcactggacacccgtgtta

SEQ ID NO: 239407 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccgactagtcatcttcgctggaccacccgcgtta

SEQ ID NO: 239408 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccgactagtcatcttcactggaccacccgtgtta

SEQ ID NO: 239409 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccctgattagtcatcttcactggacaccgtgtta

SEQ ID NO: 239410 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccctgatagtcatcttcactgggcacccgtgtta

SEQ ID NO: 239411 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccctgatagtcatcttcactggaccacccgtgta

SEQ ID NO: 239412 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccctatagtcatcttcactggaccacccgtgtta

SEQ ID NO: 239413 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccctaatagtcatcttcactggacacccgtgtta

SEQ ID NO: 239414 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgttagtcatcttcactggaccacccgtgtta

SEQ ID NO: 239415 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgattagtcgtcttcgctggacaccctgtgta

SEQ ID NO: 239416 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgattagtcatcttcactggaccaccgtgtta

SEQ ID NO: 239417 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgattagtcatctccactggacacccgtgtta

SEQ ID NO: 239418 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatgtcatcttcagctggaccacccgtgtta

SEQ ID NO: 239419 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatcagtcatcttcactggacacctgtgtta

SEQ ID NO: 239420 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatcagctcatcttcactggacacccgtgta

SEQ ID NO: 239421 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagttcgtcttcgctggaccaccgtgtta

SEQ ID NO: 239422 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagttcatcttcaactggaccaccgtgta

SEQ ID NO: 239423 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagttatcttcgctggaccacccgcgtta

SEQ ID NO: 239424 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcttcttcactggaccacccgtgtta

SEQ ID NO: 239425 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcgtcttcgctgggccacccgtgtta

SEQ ID NO: 239426 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcgtcttcactgggccacccgtgtta

SEQ ID NO: 239427 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcgtccttcactggacacccgtgtta

SEQ ID NO: 239428 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcgccttcgctggaccacccgtgtta

SEQ ID NO: 239429 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcgatcttcactggaccaccgtgtta

SEQ ID NO: 239430 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcgatctcactggaccacccgtgtta

SEQ ID NO: 239431 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtccatcttcactggacacccgtgtta

SEQ ID NO: 239432 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcgctggaccacccttgtta

SEQ ID NO: 239433 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcgctggaccacccgtgata

SEQ ID NO: 239434 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcgctggaccacccacgtta

SEQ ID NO: 239435 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcgccggaccacccgcgtta

SEQ ID NO: 239436 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttccctggaccacccgtgtta

SEQ ID NO: 239437 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcagctggaccaccgtgtta

SEQ ID NO: 239438 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcagctggacacccgcgtta

SEQ ID NO: 239439 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggaccacccgtttca

SEQ ID NO: 239440 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggaccacccggtgta

SEQ ID NO: 239441 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggaccacacgtgtta

SEQ ID NO: 239442 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggaccaaccgtgtta

SEQ ID NO: 239443 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttcactggacaacccgtgtta

SEQ ID NO: 239444 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatcttacactggacacccgtgtta

SEQ ID NO: 239445 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcatccttcactggaccaccgtgcta

SEQ ID NO: 239446 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagctcattctcactggacacccgtgtta

SEQ ID NO: 239447 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagctcatcttcgctggaccaccgtgtta

SEQ ID NO: 239448 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagctcatcttcactgaccacccgtgtta

SEQ ID NO: 239449 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagccatcttcgctggaccacccgcgtta

SEQ ID NO: 239450 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgataatcatcttcactggaccacccgtgtta

SEQ ID NO: 239451 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgactagtcatcttcgctggacacccgtgtta

SEQ ID NO: 239452 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgacagtcgtcttcgctggaccacccgtgtta

SEQ ID NO: 239453 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgacagtcatcttcactggactacccgtgtta

SEQ ID NO: 239454 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgacagtcatcttcactggaccgcccgtgtta

SEQ ID NO: 239455 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgaaagtcatcttcactggaccacccgtgtta

SEQ ID NO: 239456 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgttagtcatcttcactggacacccgtgtta

SEQ ID NO: 239457 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccggtagtcatcttcactggacacccgtgtta

SEQ ID NO: 239458 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgattagtcatcttcactggacacccgtgta

SEQ ID NO: 239459 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatgtcatcttcactggaccacccgtgtta

SEQ ID NO: 239460 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatggtcatcttcactggacacccgtgtta

SEQ ID NO: 239461 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtctcttcactggaccacccgtgtta

SEQ ID NO: 239462 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtcattttcactggacacccgtgtta

SEQ ID NO: 239463 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtcatcttcactggacacctgtgtta

SEQ ID NO: 239464 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtcatcttcactggacacccgtgtga

SEQ ID NO: 239465 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtcatcttcactggacacccgtgtca

SEQ ID NO: 239466 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtcatcttcactggacaccagtgtta

SEQ ID NO: 239467 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtcatcttcactagacacccgtgtta

SEQ ID NO: 239468 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtcatctcactggaccacccgtgtta

SEQ ID NO: 239469 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtcatctagctggaccacccgcgtta

SEQ ID NO: 239470 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgatagtcatcctcactggacacccgtgtta

SEQ ID NO: 239471 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccccgaaagtcatcttcactggacacccgtgtta

SEQ ID NO: 239472 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccagtagtcatcttcactggaccacccgtgtta

SEQ ID NO: 239473 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccagatagtcgtctcactggaccacccgtgtta

SEQ ID NO: 239474 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccagatagtcatcttcactggacacccgtgtta

SEQ ID NO: 239475 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccagatagttcatcttcactggacacccgtgtta

SEQ ID NO: 239476 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccagatagttcatcgttcactgacacccgtgtta

SEQ ID NO: 239477 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacagctcacttcgtctttgatcgaccacgctcatat

SEQ ID NO: 239478 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacagctcacttcgtcttgatcgaccactgctcataa

SEQ ID NO: 239479 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacagctcacttcgtcttcgatcgaccacgctcataa

SEQ ID NO: 239480 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacagctcacttcgtccttgatcgaccacgctcataa

SEQ ID NO: 239481 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacagcccacttcgtctttgatcgaccacgctcataa

SEQ ID NO: 239482 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacacctcacttcgtctttgatcgaccacgctcataa

SEQ ID NO: 239483 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgattgtgcgcttatggagccgggtaccttccagcaagg

SEQ ID NO: 239484 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgagcaccctgatagtcatcttcgctggaccaccgcgta

SEQ ID NO: 239485 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgagcacccgatagtcatcttcactggacacccgtgtta

SEQ ID NO: 239486 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgacacccgatcagtcatcttcactggacacccgtgtta

SEQ ID NO: 239487 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgacaccccgatagtcatcttcactggaccaccgtgtta

SEQ ID NO: 239488 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgaaacctcctggtgcaccgtgacttacgttctctttaa

SEQ ID NO: 239489 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccttgtccggcaggacgtctttcgtgcactatcacgatt

SEQ ID NO: 239490 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccctctatagtcgtcggtgtagcacgctattgcttagaag

SEQ ID NO: 239491 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccctctatagccgtcggcgtagcacgctattgcttagaag

SEQ ID NO: 239492 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccctctataatcgtcggcgtagcacgctattgcttagaag

SEQ ID NO: 239493 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccctatccgtttgtccgtcctcctgtggtattgcgcatgc

SEQ ID NO: 239494 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccctatccgcttgtccgtcctcttgtggtattgcgcatgc

SEQ ID NO: 239495 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgtgatttcctcctacctgggtagccgcgcgttgctag

SEQ ID NO: 239496 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgccctcaggttcccctaacgcgttacgcttcggaatg

SEQ ID NO: 239497 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgcaccccgatagtcatcttcactggaccaccgtgtta

SEQ ID NO: 239498 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccgcaagccatgctctagacgcctcaataagatgatgct

SEQ ID NO: 239499 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccctatcttgacgtctcttcggggactaccccgattccg

SEQ ID NO: 239500 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccatgatttccttctacctgggtagccgcgcgttgctag

SEQ ID NO: 239501 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cccaaagacttcaggcgctatcctgatctagtctaacacg

SEQ ID NO: 239502 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtgcgcttatgggagccgggtaccttccagcaacg

SEQ ID NO: 239503 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtgcgcttatggagccgggtaccttccgagcaaag

SEQ ID NO: 239504 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtgcgcttatggagccgggtacctcccagcaaggc

SEQ ID NO: 239505 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtgcgcttactggagtccggtaccttccagcaagg

SEQ ID NO: 239506 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccattgtcgcgcttatggagccgggtaccttccagcaagg

SEQ ID NO: 239507 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccagcctcaggttcccctaacgcgttagccttccggaatg

SEQ ID NO: 239508 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccactattccggtaagtcatcgtttaaccgtttgttgcaa

SEQ ID NO: 239509 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccacattcaccttcgttttatgtcctcttgcctcggacaa

SEQ ID NO: 239510 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccaacgtcacctttctcggatgcttacgcctccctgtgcg

SEQ ID NO: 239511 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattcgccggtcacatcaactatgatgacgcttgactgga

SEQ ID NO: 239512 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattcgccagtcacatcaactatgatgacgcttggctgga

SEQ ID NO: 239513 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattcaccagtcacatcaactatgatgacgcttgactgga

SEQ ID NO: 239514 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattatctcggatccgtaatctcacgcctcgctcatgccc

SEQ ID NO: 239515 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cattatccgacatcgagagagctacgccatcaagcgctaa

SEQ ID NO: 239516 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catggggcttttaagcacttctcgtaacttgggcagttac

SEQ ID NO: 239517 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catgggctttaagcactttctcggtaacttgggcagttac

SEQ ID NO: 239518 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catcttcgacacaacgtgatcacgtttggctcgctttcat

SEQ ID NO: 239519 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctctcggcccccgtgcgcacgcagctgactcgaactg

SEQ ID NO: 239520 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctatccgttgtccgtcctcttgtgtacttgcgcatgc

SEQ ID NO: 239521 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctatccgttgtccgtcctcttgtggtattgcgcatgc

SEQ ID NO: 239522 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctatccgttgtccgtcctctgtggtaattgcgcatgc

SEQ ID NO: 239523 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctatccgttgtccgtcctctgtagtaatgcgccatgc

SEQ ID NO: 239524 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catctatccgttgtccgtcctctcgtggtattgcgcatgc

SEQ ID NO: 239525 - skipped

SEQ ID NO: 239526 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catcggtgcgtcatttcccccgcctcgcctctttcgtctg

SEQ ID NO: 239527 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catcggagtctgcctatcatgtgccaccatgttgtcagga

SEQ ID NO: 239528 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catcgcttatcagcaggactctttgtgcactatcatcgat

SEQ ID NO: 239529 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catcgctatccgttgtccgacctcttgtgtatgcgcatgc

SEQ ID NO: 239530 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catcccggtggttcgtgttcagcaacgctccttaacacgg

SEQ ID NO: 239531 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catcccggtggtccgtgttcagcaacgctccttaacacga

SEQ ID NO: 239532 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
catacaaatgcacttcccctgcacattaccctccccgctg

SEQ ID NO: 239533 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagtctctcggatcaatacgctgcagtctccttccgataa

SEQ ID NO: 239534 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
cagtctcccgatatgtacatatcacttgtgaagtcttata

SEQ ID NO: 239535 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagtcgctcccaattgcgtcctccaagttgcaccggtgca

SEQ ID NO: 239536 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagtatccgtttgtccgtcctcttgtggtattgcgcatgc

SEQ ID NO: 239537 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagtatccgtttgtccgtcctctcgtggtattgcgcatgc

SEQ ID NO: 239538 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caggttcacaagtgaaaggctgctttctcacgccggtgcg

SEQ ID NO: 239539 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagcttatccgttgtccgtcctcttgtggtttgcgcatgc

SEQ ID NO: 239540 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagctattgctcatcgagcgatcatctgaaagaatatttg

SEQ ID NO: 239541 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagcgtaccatggtgggatcttagcacctccgacatataa

SEQ ID NO: 239542 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagcctcaaacactgacgtcgtggaaccttcgattgctag

SEQ ID NO: 239543 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagatgcttaagctctttcgccctaggtcctcattgccgg

SEQ ID NO: 239544 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cagatgattggaatcctgaccgcctcgattcgccgaaccg

SEQ ID NO: 239545 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactttccgtttgtccgtcctcctgtggtattgcgcatgc

SEQ ID NO: 239546 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacttatccgttgtccgtccttcttgtgtattgcgcatgc

SEQ ID NO: 239547 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacttatccgttgtccgtcctcttgtggtattgggcatgc

SEQ ID NO: 239548 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacttatccggcaggacgtctttcgtgcgctatcacgatt

SEQ ID NO: 239549 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacttatccggcaggacgtctttcgtgcactatcacgact

SEQ ID NO: 239550 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacttacccggcaggacgtctttcgtgcactatcacgatt

SEQ ID NO: 239551 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactgtccgtttgtccgtcctcttgtggtattgcgcatac

SEQ ID NO: 239552 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactgtccgtttgtccgtccccttgtggtattgcgcatgc

SEQ ID NO: 239553 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactctccgtttgtccgtcctcttgtggtattgcgcatgc

SEQ ID NO: 239554 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactccgtcggaagatcgttcgtggggcactatccccttc

SEQ ID NO: 239555 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactccgtcagaagatcgttcatggggcactatccccttc

SEQ ID NO: 239556 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatttgtttgtccgtcctcttgtggtattgcgcatgc

SEQ ID NO: 239557 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactattcgtagatccgtcattcactacgcgtatggaatc

SEQ ID NO: 239558 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatctgtttgtccgtcctctcgtggtactgcgcatgc

SEQ ID NO: 239559 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatctgacatcgagagagctacgtcatcaagcgctaa

SEQ ID NO: 239560 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcgtttgtccgtcctcttcgtggtattgcgcatgc

SEQ ID NO: 239561 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcgttgtccgtcctcttgtcggtattgcgcatcgc

SEQ ID NO: 239562 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcgttcgtccgtcctacttgtggtattgcgcatgc

SEQ ID NO: 239563 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcggtttgtccgtcctcttgtggtattgcgcatgc

SEQ ID NO: 239564 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcctcttgtccgtcctcttgtggtattgcgcatgc

SEQ ID NO: 239565 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttttgtccgtcctcttgtggtatgcgcatgc

SEQ ID NO: 239566 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttttgtccgtcctctcgtggtattgcgcatg

SEQ ID NO: 239567 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttttgtccgcctcttgtggtattgcgcatgc

SEQ ID NO: 239568 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtttgtcctctcgtggtattgcgcatgc

SEQ ID NO: 239569 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgttcgtcctcttgtggtgttgcgcatgc

SEQ ID NO: 239570 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgttcgtcctcttgcggtattgcgcatgc

SEQ ID NO: 239571 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtctgtcctcttgtggtattgcgcacgc

SEQ ID NO: 239572 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtctcgtcctcttgtggtatgcgcatcg

SEQ ID NO: 239573 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtcgtcctcttgtcggtattgcgcatgc

SEQ ID NO: 239574 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtcctcctcttgtggtcattgcgcatgc

SEQ ID NO: 239575 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgttctcttgtggtattgcgcgtgc

SEQ ID NO: 239576 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgttctctggtggtattgcgcatgc

SEQ ID NO: 239577 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcttcttgtggtgttgcgcacgc

SEQ ID NO: 239578 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtctcttacgtggtatgcgcatgc

SEQ ID NO: 239579 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccttttgtggtattgcgcacgc

SEQ ID NO: 239580 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctttcgtggtattgcgcatgc

SEQ ID NO: 239581 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctttcgtggtattgcgcacgc

SEQ ID NO: 239582 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccttcttgtgtatgcgcatagc

SEQ ID NO: 239583 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccttctcgtgtatgcgcatagc

SEQ ID NO: 239584 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttttggtattgcgcaggc

SEQ ID NO: 239585 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtgtattgcgcatgtc

SEQ ID NO: 239586 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtgttgtgcatgc

SEQ ID NO: 239587 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtgttgcgcatgt

SEQ ID NO: 239588 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtgttgcgcatgg

SEQ ID NO: 239589 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtgtcgcgcatgc

SEQ ID NO: 239590 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtcttgcgcatgc

SEQ ID NO: 239591 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtcatgcgcatgc

SEQ ID NO: 239592 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcgggc

SEQ ID NO: 239593 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcccgc

SEQ ID NO: 239594 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcatag

SEQ ID NO: 239595 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcagga

SEQ ID NO: 239596 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcacgt

SEQ ID NO: 239597 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcgcacga

SEQ ID NO: 239598 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattgcccatgc

SEQ ID NO: 239599 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtattccgcacgc

SEQ ID NO: 239600 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtatagcgcatcg

SEQ ID NO: 239601 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtactgcgcatac

SEQ ID NO: 239602 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtactacgcatgc

SEQ ID NO: 239603 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggtaattgcgcatg

SEQ ID NO: 239604 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggggttgcgcatgc

SEQ ID NO: 239605 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtgggaatgcgcatgc

SEQ ID NO: 239606 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggcgttgcgcatgc

SEQ ID NO: 239607 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggcatttcgcatgc

SEQ ID NO: 239608 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggcattgtgcatgc

SEQ ID NO: 239609 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggcattgcgcatgt

SEQ ID NO: 239610 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtggcattgcacatgc

SEQ ID NO: 239611 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtgatattgcgcacgc

SEQ ID NO: 239612 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtgatatcgcgcatgc

SEQ ID NO: 239613 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtagttttgcgcatgc

SEQ ID NO: 239614 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtagtgttgcgcatgc

SEQ ID NO: 239615 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtagtattgcgcgtgc

SEQ ID NO: 239616 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtagtattgcgcatac

SEQ ID NO: 239617 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtagtattgcgcaagc

SEQ ID NO: 239618 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgtaatattgcgcatgc

SEQ ID NO: 239619 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttggtggtatgcgcatgc

SEQ ID NO: 239620 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttgcggtattgcgcatac

SEQ ID NO: 239621 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttcgtggtattgcgcatg

SEQ ID NO: 239622 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttcgtggattgcgcatgc

SEQ ID NO: 239623 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttatggtattgcgcttgc

SEQ ID NO: 239624 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttatggtattgcgcatcg

SEQ ID NO: 239625 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcttatggtattgcgcacgc

SEQ ID NO: 239626 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctgtggtacttgcgcatgc

SEQ ID NO: 239627 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctggtggtactgcgcatgc

SEQ ID NO: 239628 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgttgtactgcgcatgc

SEQ ID NO: 239629 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgcgcataa

SEQ ID NO: 239630 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtattgcgaatgc

SEQ ID NO: 239631 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtatgcgcatgcc

SEQ ID NO: 239632 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtggtactgcgcacgc

SEQ ID NO: 239633 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtgggattgcgcatgc

SEQ ID NO: 239634 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtcgtattgcgcatgc

SEQ ID NO: 239635 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtcggtattgcgctgc

SEQ ID NO: 239636 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgtcggattgcgcatgc

SEQ ID NO: 239637 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgcggtattgcgcgtgc

SEQ ID NO: 239638 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgcggtattgcgcatac

SEQ ID NO: 239639 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcgaggtattgcgcacgc

SEQ ID NO: 239640 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctcagtgttatgcgcatcg

SEQ ID NO: 239641 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctagtggtattgcgcatat

SEQ ID NO: 239642 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctctagtggtattgcgaatgc

SEQ ID NO: 239643 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctttggtattgcgcatgc

SEQ ID NO: 239644 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtgttattgcgcatgc

SEQ ID NO: 239645 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggtattgtgcatgc

SEQ ID NO: 239646 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggtattgcgcatga

SEQ ID NO: 239647 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggtaatgcgcatgc

SEQ ID NO: 239648 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggaattgcgcatgc

SEQ ID NO: 239649 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtgatattgcgcatgc

SEQ ID NO: 239650 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtagtattgcgcatgc

SEQ ID NO: 239651 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcccttggtattgcgcatgc

SEQ ID NO: 239652 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctccagtggtattgcgcatgc

SEQ ID NO: 239653 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccgtctgtggtattgcgcatgc

SEQ ID NO: 239654 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccgctcgtggtattgcgcatgc

SEQ ID NO: 239655 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcccttgtggtattgcgcatgcc

SEQ ID NO: 239656 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcccttgtcggtattgcgcatgc

SEQ ID NO: 239657 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccccttgtggtattgcgcatac

SEQ ID NO: 239658 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccccttgtggtattgcgcacgc

SEQ ID NO: 239659 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccccctgtggtattgcgcatgc

SEQ ID NO: 239660 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccacttgtggtattgcgcatac

SEQ ID NO: 239661 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccacttgaggtattgcgcatgc

SEQ ID NO: 239662 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
cactatccgtttgtccgtcactcttgtgtatgcgcatcgc

SEQ ID NO: 239663 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtactctcgtggtattgcgcatgc

SEQ ID NO: 239664 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgcctcttgtcggtattgcgcatgc

SEQ ID NO: 239665 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgccctcttgtggtattacgcatgc

SEQ ID NO: 239666 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgatcctcttgtggtatgcgcatgc

SEQ ID NO: 239667 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgatcctctgtggtattgcgcatgc

SEQ ID NO: 239668 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgacctcttgtggtattgcgcatac

SEQ ID NO: 239669 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtcccgtcctcttgtggtattgcgcatg

SEQ ID NO: 239670 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccatcctcttgtggtattgcgcgtgc

SEQ ID NO: 239671 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtcagtcctcctgtggtattgcgcatgc

SEQ ID NO: 239672 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttggccgtcctcttgtggcattgcgcatgc

SEQ ID NO: 239673 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgctcgtcctcttgtggtattgcgcatcg

SEQ ID NO: 239674 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgctccgtcctcttgtggtattgcgcatg

SEQ ID NO: 239675 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgctccgtcctctcgtggtatgcgcatgc

SEQ ID NO: 239676 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgcctcgtcctctgtggtgttgcgcatgc

SEQ ID NO: 239677 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgccgtcctctcgtggtattgcgcatgcc

SEQ ID NO: 239678 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgcccgtcctcatgtggtattgcgcatgc

SEQ ID NO: 239679 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgcccgccctcttgtggtattgcgcatgc

SEQ ID NO: 239680 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgatccgtcctctgtggtattgcgcatgc

SEQ ID NO: 239681 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgaccgtcctcctgtggtattgcgcatgc

SEQ ID NO: 239682 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttcgtcgtcctcttgtggtattgcgcatgc

SEQ ID NO: 239683 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttatccgtcctcttgtggtatagcgcatgc

SEQ ID NO: 239684 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttaaccgtcctcttgtggtattgcgcatcg

SEQ ID NO: 239685 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtcgtccttcttgtggtattgcgcatgtc

SEQ ID NO: 239686 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtcggtcctctttgtggtattgcgcatgt

SEQ ID NO: 239687 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgttcctcttgtggtattgcgcatgc

SEQ ID NO: 239688 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtccttcttgtgtactgcgcatgtc

SEQ ID NO: 239689 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtccttcttgtcgtatgcgcatacg

SEQ ID NO: 239690 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtccttcttgtcgtactgcgcatgc

SEQ ID NO: 239691 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtccttctcgtgtattgcgcatcgc

SEQ ID NO: 239692 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtccttcctgtggtattgcgcatgc

SEQ ID NO: 239693 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtgtattgacgcatagc

SEQ ID NO: 239694 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtattgcgcatggc

SEQ ID NO: 239695 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtattgcgcagtgc

SEQ ID NO: 239696 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtattgcgcacgtc

SEQ ID NO: 239697 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtattacgcatgtc

SEQ ID NO: 239698 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtacttgcgcacgc

SEQ ID NO: 239699 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtactgcgtcatgc

SEQ ID NO: 239700 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtggtaatgcgcatgtc

SEQ ID NO: 239701 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtcgtaattgcgcatgc

SEQ ID NO: 239702 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttgtcggtattgcgtatgc

SEQ ID NO: 239703 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcttagtggtattgcgcatgc

SEQ ID NO: 239704 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctctcgtggtattgcgcattgc

SEQ ID NO: 239705 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctctcgtggtattgcgcatgac

SEQ ID NO: 239706 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctctcgtggtacttgcgcatgc

SEQ ID NO: 239707 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctctcgtggtactgcgcatgtc

SEQ ID NO: 239708 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctctagtggtattgcgcatgtc

SEQ ID NO: 239709 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcctgtggtattgcgtcatgc

SEQ ID NO: 239710 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtcctcctgtggtattgcgcatcgc

SEQ ID NO: 239711 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgtccctcttgtggtattgcgcatgc

SEQ ID NO: 239712 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgccctcttgtggtattgcgcatgtc

SEQ ID NO: 239713 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgatcctctcgtggtatgcgtcatgc

SEQ ID NO: 239714 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgtccgatcctcctgtggtactgcgcatgc

SEQ ID NO: 239715 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgctccgtcctcttgtggtattgcgcatgc

SEQ ID NO: 239716 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttgcccgtcctcttgtggtattgcgcatgtc

SEQ ID NO: 239717 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttctgtcgtcctcttgtggtattgcgcatgc

SEQ ID NO: 239718 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttctgtcgtcctcttgtcggattgcgcatgc

SEQ ID NO: 239719 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttcgtccgtccttctgtgtattgcgcatgtc

SEQ ID NO: 239720 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttcgtccgtcctcttgtggtactgcgcatgc

SEQ ID NO: 239721 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttcgtccgtcctctcgtggtattgcgcaagc

SEQ ID NO: 239722 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgttatcgagcgttgtcaacaagcggctaaggc

SEQ ID NO: 239723 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtcttaacgtgttcccttcgggcatccatcaa

SEQ ID NO: 239724 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtcctcttgtggtatcgcgcatgc

SEQ ID NO: 239725 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtcctcttgtgatattgcgcatgc

SEQ ID NO: 239726 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtcctcttgtcgtattgcgcatgc

SEQ ID NO: 239727 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtcctcttgaggtattgcgcatgc

SEQ ID NO: 239728 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtcctctgtcggtattgcgcatgc

SEQ ID NO: 239729 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtcctctcgtggtgttgcgcatgc

SEQ ID NO: 239730 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtcctctcgaggtattgcgcatgc

SEQ ID NO: 239731 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtcctcatgtggtattgcgcatgc

SEQ ID NO: 239732 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtctgtccgtccacttgtggtattgcgcatgc

SEQ ID NO: 239733 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcaacgagtggctaaggcc

SEQ ID NO: 239734 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcaacgagcggctcaggcc

SEQ ID NO: 239735 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcaacaagcggctatggcc

SEQ ID NO: 239736 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcaacaagcggctaagccc

SEQ ID NO: 239737 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcaacaagcggctaaagcc

SEQ ID NO: 239738 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcaacaagcgactaaggcc

SEQ ID NO: 239739 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtatcgagcgttgtcaacaagaggctaaggcc

SEQ ID NO: 239740 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtctctcactacgcgtatggagtc

SEQ ID NO: 239741 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactctctacgcgtatggaatc

SEQ ID NO: 239742 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcactacgcgtatgggatc

SEQ ID NO: 239743 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcactacgcgtatggaatt

SEQ ID NO: 239744 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcactacgcgtatgaaatc

SEQ ID NO: 239745 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagatccgtcactcactacgcgtagtagact

SEQ ID NO: 239746 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtagacccgtcactcactacgcgtatggagtc

SEQ ID NO: 239747 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccggtttgtccgtcctctgtggtattgcgcatgc

SEQ ID NO: 239748 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtctgtcctcttgtggtattgcgcatgc

SEQ ID NO: 239749 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtgctcttgtggtattgcgcatgc

SEQ ID NO: 239750 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcttctcgtggtattgcgcatgc

SEQ ID NO: 239751 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtggtattgctcatgc

SEQ ID NO: 239752 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtggtattgcgcaagc

SEQ ID NO: 239753 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtggtattgcacatgc

SEQ ID NO: 239754 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtggtatcgcgcatgc

SEQ ID NO: 239755 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctcttgtggtactgcgcatgc

SEQ ID NO: 239756 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtcctctcgtggtattgcgcatgt

SEQ ID NO: 239757 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgtactcttgtggtattgcgcatgc

SEQ ID NO: 239758 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtccgccctctcgtggtattgcgcatgc

SEQ ID NO: 239759 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcttgtcagtcctcttgtggtattgcgcatgc

SEQ ID NO: 239760 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgctgtccgtcctcttgtcggtattgcgcatgc

SEQ ID NO: 239761 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcctgtccgtcctctcgtggtattgcgcatgc

SEQ ID NO: 239762 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgccatcgagtcgaacagtgcgccgtttcggtg

SEQ ID NO: 239763 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgcatcgagcgctgtcaacaagcggctaaggcc

SEQ ID NO: 239764 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgagttgtccgttcctctgtgtattgcgcatgc

SEQ ID NO: 239765 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgacctcgagagagctacgtcatcaagcgctaa

SEQ ID NO: 239766 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccctagatccgtcactcactacgcgtatggaatc

SEQ ID NO: 239767 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcccgtttgtccgtctcttgtggtattgcgcatgc

SEQ ID NO: 239768 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcccgttgtcgtccctcttgtggtattgcgcatgc

SEQ ID NO: 239769 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcccgttgtccgtcctcttgtcgtattgcgcatgc

SEQ ID NO: 239770 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcccgttgtccgtcctctcgtggtattgcgcatgc

SEQ ID NO: 239771 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcgagcggtcgtcgtaatactgcctccaa

SEQ ID NO: 239772 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcgagcgatcgtcgtaatactgcatccaa

SEQ ID NO: 239773 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcgagcgatcgtagtaatactgcttccaa

SEQ ID NO: 239774 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcgagcgatagtcgtaatactgcttccaa

SEQ ID NO: 239775 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccccatcaagcgatcgtcgtaatactgcttccaa

SEQ ID NO: 239776 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccatttgtccctcctcttgtggtattgcgcatgc

SEQ ID NO: 239777 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccatttgcccgtcctcttgtggtattgcgcatgc

SEQ ID NO: 239778 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcagtttgtccgtcctctcgtggtattgcgcatgc

SEQ ID NO: 239779 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactagccgtttgtccgtcctcttgtggtattgcgcttgc

SEQ ID NO: 239780 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactacttcgttcgtccgtcccttgtggtattgcgcatgc

SEQ ID NO: 239781 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactactccgtttgtccgtcctctgtggtattgcgcatgc

SEQ ID NO: 239782 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactaccgtttgttccgtcctcttgtggtattgcgcatgc

SEQ ID NO: 239783 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactaccgtttcgtccgtcctcttgtggtattgcgcatgc

SEQ ID NO: 239784 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactacccgtttgtccgtcctcttgtggtattgcgcatga

SEQ ID NO: 239785 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactacccgtttgtccgtcctcttgtggtattgcgcacgc

SEQ ID NO: 239786 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactacccgtttgtccgtcctctcgtggtactgcgcatgc

SEQ ID NO: 239787 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactacccgtttgtccggcctcctgtggtattgcgcatgc

SEQ ID NO: 239788 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactacccgtttgtccatcctcttgtggtattgcgcatgc

SEQ ID NO: 239789 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactaaccgtttgtccgtcctcttgtggtattgagcatgc

SEQ ID NO: 239790 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
cacgttgaatgttatccgccttgcctccgtccctaagctg

SEQ ID NO: 239791 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgtggtcctactctctcggatattgtgcacgccggctg

SEQ ID NO: 239792 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgtgcctccaatatgcatctcggacattcctcctcccg

SEQ ID NO: 239793 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgtctccccactgatgcatgcttcatggtctctacgta

SEQ ID NO: 239794 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgtccatctagttcgtcagtactgacgtgggtgcacca

SEQ ID NO: 239795 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgtatccgtttgtccgtcctctgtggtattgcgcatgc

SEQ ID NO: 239796 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacggttatgtctgacttcgggcgctatcctgattttcgt

SEQ ID NO: 239797 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacggacgatcctcaccccatatgccgcctcgactgttaa

SEQ ID NO: 239798 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgccggactacctgcgatgaatgaccgcgactgtgttt

SEQ ID NO: 239799 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgccggactacctgcgatgaatgaccgcaactgtgttt

SEQ ID NO: 239800 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacgatccgtttgtccgtcctctcgtggtattgcgcatgc

SEQ ID NO: 239801 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacctgtagtcgtcccgtgcgtatgggtcgaaatgccgct

SEQ ID NO: 239802 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacctgtagtcgtcccgtcgcgtgtgggtcaaatgccgct

SEQ ID NO: 239803 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacctatcgttgtccgtcctcttgtggtacttgcgcatgc

SEQ ID NO: 239804 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacctatcgcttgtccgtcctcttgtcgtattgcgcatgc

SEQ ID NO: 239805 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacctatccgtttgtccgtcctcttgtggtattgcgctgc

SEQ ID NO: 239806 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacctatccgtttgtccgtcctctcgtgtattgcgcatgc

SEQ ID NO: 239807 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacctatccgttgtcgtcctcttgtcggtattgcgcatgc

SEQ ID NO: 239808 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacctatccgttgtccgtccttcttgtgtattgcgcatgc

SEQ ID NO: 239809 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacctatccgttgtccgtcctcttgtggtattgcgcatgc

SEQ ID NO: 239810 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacctatccgttgtccgtcctcctgtcgtattgcgcatgc

SEQ ID NO: 239811 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacctatccgtctgtccgtcctctgtggtattgcgcatgc

SEQ ID NO: 239812 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccgggagtccctcctcgtcttgatgcactatcatctca

SEQ ID NO: 239813 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccggaagttcctcctcgtcttgatgcactatcatctcg

SEQ ID NO: 239814 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccggaagtccctcctcgtcttgatgcactgtcatctca

SEQ ID NO: 239815 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccggaagtccctcctcgtcttgatgcactatcatcaca

SEQ ID NO: 239816 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccggaagtccctcctcgccttgatgcactatcatctca

SEQ ID NO: 239817 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccggaagtccctccccgtcttgatgcactatcatctca

SEQ ID NO: 239818 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccggaaatccctcctcgtcttgatgcactatcatctca

SEQ ID NO: 239819 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccgaaggcctctctaaccgcctcatactcgtactcgct

SEQ ID NO: 239820 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatcgttcgttcgtcctccttgtggtattgcgcatgc

SEQ ID NO: 239821 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgtttgtccgtcctcttgtggtattgcgcatac

SEQ ID NO: 239822 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgtttgtccgtcctcttgtggtattgcgcacgc

SEQ ID NO: 239823 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgtttgtccgtcctcttgtggacttgcgcatgc

SEQ ID NO: 239824 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgtttgtccgacctcttgtggtattgcgcatgc

SEQ ID NO: 239825 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgttgtccgtcctcttgtggtattgcgccatgc

SEQ ID NO: 239826 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgcttgtccgtcctcttatggtattgcgcatgc

SEQ ID NO: 239827 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgcttgtccgtcctctcgtggtattgcgcatgc

SEQ ID NO: 239828 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caccatccgattgtccgtcctcttgtggtattgcgcatgc

SEQ ID NO: 239829 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacattcttcccgggttgctgccttgattctccctagctg

SEQ ID NO: 239830 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacagaggccctcgtgttggactaccaacttgtagaacgg

SEQ ID NO: 239831 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cacaatccgtttgtccgtcctcctgtggtattgcgcatgc

SEQ ID NO: 239832 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgtcatcctatcttctcggatcactggtcctcctaga

SEQ ID NO: 239833 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatggattctcgtgacactcgaagcacttcccagatgca

SEQ ID NO: 239834 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgcttgatctcctgttgactctgcggctgagactact

SEQ ID NO: 239835 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgcttgatctcctgtcgactctgtggctgagactact

SEQ ID NO: 239836 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgcttgatctcctgtcgactctgcggccgagactact

SEQ ID NO: 239837 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgcttgatcacctgtcgactctgcggctgagactact

SEQ ID NO: 239838 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caatgctcgatctccagtcgactctgcggctgagactact

SEQ ID NO: 239839 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caagttcctccatgtcgcatcgtattactgttctctgctg

SEQ ID NO: 239840 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caaggcatgtcgttgcgagcctcgattccaaccacgtctg

SEQ ID NO: 239841 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caagccgggcctgcctcaagctagctacctccattgcctg

SEQ ID NO: 239842 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caagccgggcctgcctcaagctagctaccgtccattgctg

SEQ ID NO: 239843 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caaccggggcctgcctcaagctagctacctccattgtctg

SEQ ID NO: 239844 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caaccggggcccacctcaagctagctacctccattgtctg

SEQ ID NO: 239845 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caacatctcggattcagcctacacgcatctccttcgccta

SEQ ID NO: 239846 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caaattatcagggactaccctgacgcaatatttacacgtt

SEQ ID NO: 239847 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
caaacgggtcctcatactataggctcgttctccacggctg

SEQ ID NO: 239848 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atttccctataggtcgttttttgtacgccattacaattac

SEQ ID NO: 239849 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attgtccatgagtcttctggcactatccagttgacgctca

SEQ ID NO: 239850 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attgatttcagcgacttcggtggtgtcctctccattacca

SEQ ID NO: 239851 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attgattcttattggtggcacactattgccttgaacttca

SEQ ID NO: 239852 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attgattccagcgacttcggtgctgtcctctccattacca

SEQ ID NO: 239853 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attcttagtgtgtattcatttcagggactaccctgcatca

SEQ ID NO: 239854 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attcggtgtgctgctcgttgtgcgctatcacattaaaggc

SEQ ID NO: 239855 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attccgttagagaaactctgttggccactatgccatcaat

SEQ ID NO: 239856 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attcccctgagtgttgcagtcggtcaagcactatcttgaa

SEQ ID NO: 239857 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attcatggtacgcctcgattccgcccatacatgcatgtaa

SEQ ID NO: 239858 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attatccgcatcacatcaactatgatgacgcttgactgga

SEQ ID NO: 239859 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attagtgatttcgccgcccctctgtttagtggccattgga

SEQ ID NO: 239860 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaatttcagcgacttcggtggtgtcctctccattacca

SEQ ID NO: 239861 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcggcttcggtggtgtcctctccattacca

SEQ ID NO: 239862 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttcggtggtgtcctctccgttacca

SEQ ID NO: 239863 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccagcgacttcggtggtgccctccccattacca

SEQ ID NO: 239864 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attaattccaacgacttcggtggtgtcctctccattacca

SEQ ID NO: 239865 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtgccattgagtttctggcactatccagttgacgctca

SEQ ID NO: 239866 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtcctcggttgggccggtcttggatcactatatccttt

SEQ ID NO: 239867 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccgtgacgcttctggcatctatccagttgacgctca

SEQ ID NO: 239868 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccattgacgcttctggcactatccagttgacgctca

SEQ ID NO: 239869 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgtagtctctcggcactatccagttgacgctca

SEQ ID NO: 239870 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgtagcttctcggcactatccagttgacgctca

SEQ ID NO: 239871 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgagcttctggtcactatccagttgacgtctca

SEQ ID NO: 239872 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgagcttctggccacttatccagttgacgctca

SEQ ID NO: 239873 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgacgtcttctggcactatccgattgacgctca

SEQ ID NO: 239874 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgacgtcttctcggcactatcgattgacgctca

SEQ ID NO: 239875 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgacgtctctcggcactatcgagttgacgctca

SEQ ID NO: 239876 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgacgtctctcggcactatccagttgacgctca

SEQ ID NO: 239877 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgacgcttctggcacttatccagttgacgctca

SEQ ID NO: 239878 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgacgcttctggcactatccgagttgacgctca

SEQ ID NO: 239879 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgacgctctggccatctatccagttgacgctca

SEQ ID NO: 239880 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgacgctctggacatctatccagttgacgctca

SEQ ID NO: 239881 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccatgacgctctggacactatccagttgacgctcga

SEQ ID NO: 239882 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgtccacgagctctgacactatccagcttgacgtctcga

SEQ ID NO: 239883 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtttcttctcctgactacatgagattaataaacgcgc

SEQ ID NO: 239884 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggttcatgagtcttctggcactatccagttgacgctca

SEQ ID NO: 239885 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggttcatgagcttctggcactatcccagttgacgctca

SEQ ID NO: 239886 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtggctttaagcacttctcggtaacttggagagttac

SEQ ID NO: 239887 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtggctttaagcacttcgtcgatacttgggcagttac

SEQ ID NO: 239888 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtgcttttaagcacttctcggtaacttgggcagttac

SEQ ID NO: 239889 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtgcgactacgctcttgaacaattctgatcctggatt

SEQ ID NO: 239890 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtgccattgagcttctggcactatcagttgacgctca

SEQ ID NO: 239891 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccgtgagcttctggcactactccagttgacgctca

SEQ ID NO: 239892 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccgtgagccttctggcactatccagttgacgctca

SEQ ID NO: 239893 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtcccgtgagcttctggcactatccagttgacgctca

SEQ ID NO: 239894 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtcccatgggcttctggcactatccagttgacgctca

SEQ ID NO: 239895 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtcccatgagtcttctggcactatcagttgacgctca

SEQ ID NO: 239896 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtcccatgagcttctggcattatccagttgacgctca

SEQ ID NO: 239897 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtcccatgagcctctggcactatccagttgacgctca

SEQ ID NO: 239898 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccattgagcctctggcactatccagttgacgctca

SEQ ID NO: 239899 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgtagcttctggcactatcaagttgacgctca

SEQ ID NO: 239900 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgtagcttctggcaccatccagttgacgctca

SEQ ID NO: 239901 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgggcttctggcactatcccagttgacgctca

SEQ ID NO: 239902 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgggcttctggcactatccagttgaccgctca

SEQ ID NO: 239903 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagtcttctggcatctatccattgacgctca

SEQ ID NO: 239904 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagtcttctggcactatctagttgacgctca

SEQ ID NO: 239905 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagtcttctggcactatccagttgtcgctca

SEQ ID NO: 239906 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagtcttctggcactatccagttggcgctca

SEQ ID NO: 239907 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagtcttctggcactatccagttgactctca

SEQ ID NO: 239908 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagtcttctggcactatccagttaacgctca

SEQ ID NO: 239909 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagtctctggccactatccagttgacgctca

SEQ ID NO: 239910 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagtctcctggcactatccagttgacgctca

SEQ ID NO: 239911 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactatccgagttgacgctcg

SEQ ID NO: 239912 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagcttctggcactactccagtcgacgctca

SEQ ID NO: 239913 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagctctggcactatccagtgacgctacgac

SEQ ID NO: 239914 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagctctggacactatcagttgacgtctcga

SEQ ID NO: 239915 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgagctcctggacactatccagttgacgctca

SEQ ID NO: 239916 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgacgtcttctggcactatccattgacgctca

SEQ ID NO: 239917 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccatgacgctctggcactatccgagttgacgctca

SEQ ID NO: 239918 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
atggtccatgaccttctggcactattccagttgacgctca

SEQ ID NO: 239919 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccactgagcttctggacactatccattgacgctca

SEQ ID NO: 239920 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtccacgagcttctggcactatcccagttgacgctca

SEQ ID NO: 239921 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggtaccatgagcttctggcactatccagttgacgctca

SEQ ID NO: 239922 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggcccatgagtcttctggcactatccagttgacgctcg

SEQ ID NO: 239923 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggcccatgagtcttctggcactatccagttgacgctca

SEQ ID NO: 239924 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggagctttaagcacttctcggtaacttggagcagttac

SEQ ID NO: 239925 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atggacttcgggtcacgcctcgctcctccaaacctatctg

SEQ ID NO: 239926 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgcgaactgctgttttggcgctatccaaattttaagcta

SEQ ID NO: 239927 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgatggcttttaagcacttctcggtacttgggcagttac

SEQ ID NO: 239928 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgatgccatgagcttctggcactatccagttgacgctca

SEQ ID NO: 239929 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgatccatgagtcttctggcactatccagttgacgctca

SEQ ID NO: 239930 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgagaagcgtgtgagagactactctgtttgtaacgcaat

SEQ ID NO: 239931 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atgaacttgtgaatcgtttacctctggactacctgggcaa

SEQ ID NO: 239932 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atctgcgccggttcctcattctcccgactacgtgagatta

SEQ ID NO: 239933 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atctccgtctaactacgtgcactatcacggcttagttaga

SEQ ID NO: 239934 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgtcgggccccttttatgaaacttacatgagagcgcac

SEQ ID NO: 239935 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcgtcgggccccttttatgaaacgtacatgaaagcgcac

SEQ ID NO: 239936 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcggtgacagatctgcccctctgcatatggaccatttcg

SEQ ID NO: 239937 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcggtccatgagcttctggcactatccagttgatgctca

SEQ ID NO: 239938 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcggtccatgagccttctggcactatcagttgacgctca

SEQ ID NO: 239939 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcggtccactgagcttctggcactatccactgacgctca

SEQ ID NO: 239940 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgggtaccgctcgactactgaccggtcacctgtacag

SEQ ID NO: 239941 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaccgcctcgattaccccggtaccgttatgcataa

SEQ ID NO: 239942 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaagtccctcctcgtcttgatgcactatcatctca

SEQ ID NO: 239943 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgccttgatcctcgcatagtatgatacgtctg

SEQ ID NO: 239944 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgccttgatcctcgcataatatgatacgtcgg

SEQ ID NO: 239945 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatccttgcataatatgatacgtctg

SEQ ID NO: 239946 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgtataatatgatacgtctg

SEQ ID NO: 239947 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcatagtatgctacgtctg

SEQ ID NO: 239948 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcatactatgatacgtctg

SEQ ID NO: 239949 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcataatatgatacttctg

SEQ ID NO: 239950 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccggaacgcctcgatcctcgcataatatgatacgtcta

SEQ ID NO: 239951 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgcctcgcttgtgcacaactcgcattccgcgtctgcg

SEQ ID NO: 239952 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgcctcgcttgtcgcacaactcgcatccgcgtctgcg

SEQ ID NO: 239953 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccgcctcgatatcatcactagtgggctcccctcgtttg

SEQ ID NO: 239954 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcccgtttagagaaatctgttggccactatgccatcaat

SEQ ID NO: 239955 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtgcgcctcgattccgcccatacatgcatgtaa

SEQ ID NO: 239956 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcttcgattccgcccatacatgcatgtaa

SEQ ID NO: 239957 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcgtcgattccgcccatacatgcatgtaa

SEQ ID NO: 239958 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgtactccgccatacatgcatgtaa

SEQ ID NO: 239959 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcggttccgcccatacatgcatgtaa

SEQ ID NO: 239960 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgatttcgcccatacatgcatgtaa

SEQ ID NO: 239961 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgatttccgccatacatgcatgtaa

SEQ ID NO: 239962 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgccctacatgcatgtaaa

SEQ ID NO: 239963 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgcccatatatgcatgtaa

SEQ ID NO: 239964 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgcccatacatgcctgtaa

SEQ ID NO: 239965 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgcccatacatgcatgaaa

SEQ ID NO: 239966 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattccgccaatacatgcatgtaa

SEQ ID NO: 239967 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtacgcctcgattacgcccatacatgcatgtaa

SEQ ID NO: 239968 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccatggtaccgcctcgattccgccatacatgcatgtaa

SEQ ID NO: 239969 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atccacggtacgcctcgattccgcccatacatgcatgtaa

SEQ ID NO: 239970 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcagactgcccgtctacgcgctgggctaccaccgtatag

SEQ ID NO: 239971 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atcactatccggtaagtcatcgtctaaccgttcgttgcaa

SEQ ID NO: 239972 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atatgggctttaagcacttctcagtaacttgggcagttac

SEQ ID NO: 239973 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ataggtcctggggtatccgcctcgctaagttcgtgcatgc

SEQ ID NO: 239974 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atactatcccggtaagtcatcgtttaaccgtttgttgcaa

SEQ ID NO: 239975 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
atacgttgattctcggaccgcctcaaacatatccgcttcg

SEQ ID NO: 239976 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ataccggtacgccttgtgtcgccccgtgtgttgcaacaga

SEQ ID NO: 239977 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ataatcacccctgaacggctacgttctcaaatgattaacg

SEQ ID NO: 239978 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agttcgtacgctataccgcctcgttctccattagaacccg

SEQ ID NO: 239979 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtgtctgaccgccttgatccttcttctcggaaacgcgta

SEQ ID NO: 239980 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtggcactgcgcctgggtttccttcccaaagaagtcgtt

SEQ ID NO: 239981 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtgcccgaccgccttgatccttcttctcggaaacgcgta

SEQ ID NO: 239982 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtctcgagatcactaggcactatcctagcactgtatcaa

SEQ ID NO: 239983 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtcggacacgccttgttcctcctctcgggtcattgacat

SEQ ID NO: 239984 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtcattaacccttgttggactaccaccaaaaacgattaa

SEQ ID NO: 239985 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtaggtcgcctggtccgcctcgatcctctataccgtctg

SEQ ID NO: 239986 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtactacgcctcgaggagctctcacctccctctgtccag

SEQ ID NO: 239987 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agtaaattctcggatcacatctgcaccgcctcggccgacc

SEQ ID NO: 239988 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aggatctcggatctggcgtactacttggacaggttccttc

SEQ ID NO: 239989 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agctgtcgacgtctctacctctgctccttccaagtgtctg

SEQ ID NO: 239990 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agctaacccacatcgagcggtctcagatgttaaaatacaa

SEQ ID NO: 239991 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agcctcaagtctaatctgaacgctatttcagatgtataga

SEQ ID NO: 239992 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agcccgggtccgcctcgcaaccgttgcaactgtatcgttc

SEQ ID NO: 239993 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agagcttactccggcgcgtcatcgaccataccgacggaca

SEQ ID NO: 239994 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agactactccgatggacaatcgtaacttaggagccgccta

SEQ ID NO: 239995 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agaccggggcccgccccaagctagctacctccattgtctg

SEQ ID NO: 239996 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agacccgggttccgcctcagtccccaaaatgcgcgcattt

SEQ ID NO: 239997 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agaagcacctcaacccgttactaaacctctgcttctccaa

SEQ ID NO: 239998 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
agaagacgtcggactacgcctcgattcctcctgggtagcg

SEQ ID NO: 239999 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actttgcaatgatccgccttgatcctccagttgcaactta

SEQ ID NO: 240000 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actgtaggcacctgctctatgttgtggggagtaacaggtt

SEQ ID NO: 240001 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actcttatccggcaggacgtctttcgtgcactatcacgat

SEQ ID NO: 240002 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actctgttttttaggttggcgaggtcctctaacttttggg

SEQ ID NO: 240003 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actaccttcgtctagcggtgcgctggggactttatccctc

SEQ ID NO: 240004 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actaccttcgtcaagcgtgaatctgtcattatgaccaagg

SEQ ID NO: 240005 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actacccccagttttagtccttcctaaaagggccctttga

SEQ ID NO: 240006 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
actacccccagtttagtccttcctaaaaggggccctttga

SEQ ID NO: 240007 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgtgtcatatatctgactacagattttgtcatggcacta

SEQ ID NO: 240008 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acggtttcttctcctgactacatgtgattaataaacgcgc

SEQ ID NO: 240009 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acggtttcttctcctgactacatgaggttaataaacgcgc

SEQ ID NO: 240010 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acggtttcttctcctgactacatgagattagtaaacgcgc

SEQ ID NO: 240011 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acggtttcttctcctgactacatgagattaataagcgcgc

SEQ ID NO: 240012 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgggattttcgtcctgactttagccgcctctaaggatga

SEQ ID NO: 240013 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acggcgctctcggatctacatgtctatcgtcctctcggta

SEQ ID NO: 240014 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgcgtacgccttggttttcctgggtacccccaccgtttg

SEQ ID NO: 240015 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgcacagctcacttcgtctttgatcgaccacgctcataa

SEQ ID NO: 240016 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttcctcggcttccgcggtgcaggatttgcacgt

SEQ ID NO: 240017 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttcctcggcctccgcggtgcaggatttgcacgt

SEQ ID NO: 240018 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttcctcagcttccgcggtgcagggtttgcacgt

SEQ ID NO: 240019 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttcctcagcctccgcggttgcaggattgcacgt

SEQ ID NO: 240020 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttcctcagcctccgcggtgctggatttgcacgt

SEQ ID NO: 240021 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttcctcagcctccgcggtgcagggtttgcacgt

SEQ ID NO: 240022 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttcctcagcctccgcggtgcaggatctgcacgt

SEQ ID NO: 240023 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgatccttccccagcctccgcggtgcaggatttgcacgt

SEQ ID NO: 240024 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgactcttcctcagcttccgcggtgcaggatttgcacgt

SEQ ID NO: 240025 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgactattccggtaagtcatcgtttaaccgttgttgcaa

SEQ ID NO: 240026 - skipped

SEQ ID NO: 240027 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acgacctattccggtaagtcatcgttaccacttgttgtca

SEQ ID NO: 240028 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acctgcttgtgtgcgacacatgactacgactcctcttcag

SEQ ID NO: 240029 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acctcggatcttacattagcgctaccttcccagcattctg

SEQ ID NO: 240030 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acctatcttgacgtctcttcggggactacccccgattctg

SEQ ID NO: 240031 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgtactctagctacgtctcttgggacctacccgatctg

SEQ ID NO: 240032 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accggccctcaggtccctaacgcgttacgccttccggatg

SEQ ID NO: 240033 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accggcaccccgatagtcatcttcgctggaccaccgcgta

SEQ ID NO: 240034 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgccttgacaatagctattaatcacttccgttgcagat

SEQ ID NO: 240035 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgccttcagttctactgtattaccgcggatacagttac

SEQ ID NO: 240036 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcctcaggtcccctaacgcgttacgctttccggaatg

SEQ ID NO: 240037 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcctcaggccattgctggctatgccccgatgtacgtg

SEQ ID NO: 240038 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcatgggtcggttttggtggggggctacccccttgta

SEQ ID NO: 240039 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcatgggtcggttttggtgggggactaccctcttgta

SEQ ID NO: 240040 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcatgggtcggtcttggtgggggactacccccttgta

SEQ ID NO: 240041 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgcacccgactagtcatccttcactggacaccgtgata

SEQ ID NO: 240042 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgatgtcgccgactatgagccggtaccttccagcaagg

SEQ ID NO: 240043 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accgaacctgtagctgtttgcgactacccaattagggcta

SEQ ID NO: 240044 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accctatcttgacgtctcttcgggggctaccccgattctg

SEQ ID NO: 240045 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accctatcttgacgtctcttcggggactgccccgattctg

SEQ ID NO: 240046 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
accctatcttgacgtatcttcggggactaccccgattctg

SEQ ID NO: 240047 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accctatcttaacgtctcttcggggactaccccgattctg

SEQ ID NO: 240048 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accctatctcgacgtctcttcggggactaccccgattctg

SEQ ID NO: 240049 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accctaccttgacgtctcttcggggactaccccgattctg

SEQ ID NO: 240050 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acccggaacgcctcgatcctcgcataatatgatacgtctg

SEQ ID NO: 240051 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accccgctgagcatgggcaatgctcaccttggactctcct

SEQ ID NO: 240052 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
accccatcttgacgtctcttcggggactaccccgattctg

SEQ ID NO: 240053 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acatttcggatcctgtccgctttaggatccctcatgttta

SEQ ID NO: 240054 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acattacccggtcagcttctcgtctgtaatttgcatgcat

SEQ ID NO: 240055 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acatcagcctcggttatcttacgcgtacctctcatgcgca

SEQ ID NO: 240056 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagtgtgttccatgctttaggcgcctcttattttgggtc

SEQ ID NO: 240057 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagtgggttccatgctttagggcgcctcttatttgggtc

SEQ ID NO: 240058 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagtgggttccatgcttcaggcgcctcttattttgggtc

SEQ ID NO: 240059 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcttattccggtaagtcatcgttcaccgttgttgcaa

SEQ ID NO: 240060 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagctgacacctttgactctccatgttgccggcacggac

SEQ ID NO: 240061 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagccactggactctcagcgcgcgacccatctctcagta

SEQ ID NO: 240062 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactgggctctcagcgcgcgaccccatctctcagta

SEQ ID NO: 240063 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactggactctcatgcgcgcgacccatctctcagta

SEQ ID NO: 240064 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactggactctcagtgcgcggacccatctctcagta

SEQ ID NO: 240065 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactggactctcagcgcgcgacccatctcgtcagta

SEQ ID NO: 240066 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactggactctcagcgcgcgacccatctcgtcagca

SEQ ID NO: 240067 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcactggactctcagcgccgcgacccatctctcagta

SEQ ID NO: 240068 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acagcacgggactctcagcgcgcgacccatctcgtcggta

SEQ ID NO: 240069 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactgttccggtaagtcatcgtttgaccgtttgttgcaa

SEQ ID NO: 240070 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtgagtcatcgtttaaccgcttgttgcaa

SEQ ID NO: 240071 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtccttaccgtcctcaatacggacgaatg

SEQ ID NO: 240072 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaggtcatcgtttaaccgcttgttgcaa

SEQ ID NO: 240073 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaggtcatcgttcaaccgtttgtcgcaa

SEQ ID NO: 240074 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagttatcgtttaaccgcttgttgcaa

SEQ ID NO: 240075 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcgatcgttaaccgcttgttgcaa

SEQ ID NO: 240076 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatggtttaaccgtttgttgcaa

SEQ ID NO: 240077 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgttttaccgtttgttgcaa

SEQ ID NO: 240078 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttgaccgtttgctgcaa

SEQ ID NO: 240079 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttcaccgtttgttgcaa

SEQ ID NO: 240080 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttagccgtttgttgcag

SEQ ID NO: 240081 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttacccgtttgttgcaa

SEQ ID NO: 240082 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaatcgtttgttgcaa

SEQ ID NO: 240083 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaactgtttgttgcaa

SEQ ID NO: 240084 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccttttgttgcaa

SEQ ID NO: 240085 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgttgttgtcaa

SEQ ID NO: 240086 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccgcttgttgcag

SEQ ID NO: 240087 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaacccgttgttgcaa

SEQ ID NO: 240088 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtttaaccattcgttgcaa

SEQ ID NO: 240089 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgttctaccgtttgttgcaa

SEQ ID NO: 240090 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgttactacgtttgttgcaa

SEQ ID NO: 240091 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgttaaccgttttgttgcaa

SEQ ID NO: 240092 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgttaacccgtttgttgcaa

SEQ ID NO: 240093 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtgtaaccgtttgttgcaa

SEQ ID NO: 240094 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgtctaaccgtttggtgcaa

SEQ ID NO: 240095 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgcttgaccgtttgttgcaa

SEQ ID NO: 240096 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtcatcgcttagccgtttgttgcaa

SEQ ID NO: 240097 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagtaatcgtttaaccgtttgttgcaa

SEQ ID NO: 240098 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagccatcgttcaaccgtttgttgcaa

SEQ ID NO: 240099 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagccatcgtctaaccgtttgttgcaa

SEQ ID NO: 240100 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaagcatcgttcataccgtttgttgcaa

SEQ ID NO: 240101 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccgggaagtcatcgtttaaccgtttgttgcaa

SEQ ID NO: 240102 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggccttcaccgtccttaatacggacgaatg

SEQ ID NO: 240103 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggccttcaccgtcctcaatccggacgaatg

SEQ ID NO: 240104 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggccttcaccgtcctcaatacggacgaatt

SEQ ID NO: 240105 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggccttcaccgtcctcaatacggacgaagg

SEQ ID NO: 240106 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggccttcaccgtcctcaatacgaacgaatg

SEQ ID NO: 240107 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggccttcaccgtcctcaatacagacgaatg

SEQ ID NO: 240108 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggcaagtcatcgtttgaccgtttgttgcaa

SEQ ID NO: 240109 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggaagtcatcgtttaacccgtttgttgcaa

SEQ ID NO: 240110 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccagtaagccatcgtttaaccgtttgtcgcaa

SEQ ID NO: 240111 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactatccgttgtccgtcctcttgtgtattgcgcatgtc

SEQ ID NO: 240112 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acaccattccggtaagtcatcgtttaaccgtttgttgcaa

SEQ ID NO: 240113 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acaccaacgctctgtatacgctggactacccgcgtttcaa

SEQ ID NO: 240114 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acaatgggttccatgctttaggcgcctcttattttgggtc

SEQ ID NO: 240115 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacgtacgcctgggtcactctttgttctg

SEQ ID NO: 240116 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacatgcgcctgggtcactcttcgttctg

SEQ ID NO: 240117 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgttaagcttacatacgcctgggctgctctttgttctg

SEQ ID NO: 240118 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgtcaagcttacatacgcctgggtcactctttgttctg

SEQ ID NO: 240119 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgtaggcacctgctctatgtcgtggggagtaacaggtt

SEQ ID NO: 240120 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatggttacgcttacatacgcctgggtcactcttgttctg

SEQ ID NO: 240121 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatgggcttttaagcgacttctcggtaacttggcagttac

SEQ ID NO: 240122 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatctcgagatcactaggcgctatcccagcactgtatcaa

SEQ ID NO: 240123 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatctcgagatcactaggcactatcctagcaccgtatcaa

SEQ ID NO: 240124 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcgtgctcgagcattccgtctcgatcttttccagtctg

SEQ ID NO: 240125 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcgggaccgcctcaagctagctacctccattggtccta

SEQ ID NO: 240126 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcgggaccgcctcaagctagctacctccattggcctga

SEQ ID NO: 240127 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcgcgctgccctttgtttaaggcctttatacaaacgca

SEQ ID NO: 240128 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatccatggtacgcctcgattccgccatacatgcatgtaa

SEQ ID NO: 240129 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcatcagtaattctgcccctctgatgaaacggttactt

SEQ ID NO: 240130 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagttaattctgccctctgatgaaaccggttactt

SEQ ID NO: 240131 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattctgccctctgatgaaaccggcttactt

SEQ ID NO: 240132 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aatcacagtaattctgcccctctggtgaaaccggttactt

SEQ ID NO: 240133 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagcgtttgtactgtgtcgcacgctattgcgaggtaacat

SEQ ID NO: 240134 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagcgctttgtatgtgtcgcacgctattgcgaggtaacat

SEQ ID NO: 240135 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagccggggcccgcctcaagctagttacctccattgtctg

SEQ ID NO: 240136 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagatctcggatctggcgtactacttggacaggttccctc

SEQ ID NO: 240137 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aagatctcggatctgcgtactacttcggacaggttcctcc

SEQ ID NO: 240138 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aactcggatctcatctaactcctgaaccgggccatctaag

SEQ ID NO: 240139 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aactcgccagtcacatcaactatgatgacgcttgactgga

SEQ ID NO: 240140 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aactatccgtttgtccgtcctcttgtggtgttgcgcatgc

SEQ ID NO: 240141 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aactatccgtttgtccgtcctcttgtggtattgcgcgtgc

SEQ ID NO: 240142 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacgtactccatccgcctgggctcctcccagttacgactg

SEQ ID NO: 240143 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacgtaccccagctttagtccttcctaaagggccctttga

SEQ ID NO: 240144 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacgggcccggcctcaagctagctacctccattcgtcctg

SEQ ID NO: 240145 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacgggcccgctcaacgtctagctcacctccattgtcgtg

SEQ ID NO: 240146 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacggaccggccgcctcaagctagctacctccattgtctg

SEQ ID NO: 240147 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgtacccccagtttagtcctcctaaagggccctttga

SEQ ID NO: 240148 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggtgccgcctcaagtctagctacctccattgtctg

SEQ ID NO: 240149 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggtgcccgcctcaagctagctacctccattgtctg

SEQ ID NO: 240150 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccggggtccgcctcaagctagctacctccacttgtctg

SEQ ID NO: 240151 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggggcccgcctcaagctagctacctccattgtctg

SEQ ID NO: 240152 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccggggcccgcctcaagctagctaccttccattgctgc

SEQ ID NO: 240153 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccggggcccgcctcaagctagctacctccattgtctga

SEQ ID NO: 240154 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccggggcccgcctcaagctactaccgtccattagtctg

SEQ ID NO: 240155 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccggggacccgcctcaagctagctacctccattgtctg

SEQ ID NO: 240156 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggccgcctcaacgtctgctcacctccattgtcgtg

SEQ ID NO: 240157 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgctcagctagctcaccgtccagttgttctg

SEQ ID NO: 240158 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgctcacgtctagctcacctccattgtcgtg

SEQ ID NO: 240159 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgctcaagctagctcacctccattcgtcctg

SEQ ID NO: 240160 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgctcaagcctagctgacctccattcgtctg

SEQ ID NO: 240161 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgctcaagcctagctacctccacttcgtctg

SEQ ID NO: 240162 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgctcaacgtctagctcacctccattgtctg

SEQ ID NO: 240163 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgctcaacgtctagctacctccattgtctga

SEQ ID NO: 240164 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgctcaacgtcagctcacctccattgtcgtg

SEQ ID NO: 240165 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgctcaacgctagcctacctccattgtcgtg

SEQ ID NO: 240166 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaagtcctagctacctccattgtctg

SEQ ID NO: 240167 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaagctagctaccttccattgcctgc

SEQ ID NO: 240168 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaagctagctacctccattgtcctgc

SEQ ID NO: 240169 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaagctactcgacctccattgtcgtg

SEQ ID NO: 240170 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaagcctagctacttccacttgtctg

SEQ ID NO: 240171 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaagcctagctacctccacttgactg

SEQ ID NO: 240172 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaacgctaggctaccttccattgctg

SEQ ID NO: 240173 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggcccgcctcaacgctagctcacctccattgtcgg

SEQ ID NO: 240174 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
aaccgggcccgcctcaacgctagctacctccattatcgtg

SEQ ID NO: 240175 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggccccgccctcaagctagctacctccattgtctg

SEQ ID NO: 240176 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggaccgcctcaagcctagctacctaccattgtctg

SEQ ID NO: 240177 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccgggacccgccttcaagctagctacctccattgtctg

SEQ ID NO: 240178 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccggcccgcctcaagccctactacgtcacttcggactg

SEQ ID NO: 240179 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccggagcccgcctcaagctagctaccttccattgtctg

SEQ ID NO: 240180 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccggaccgcctcaacgtctagctacctccattgtcgtg

SEQ ID NO: 240181 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaccggaagtccctcctcgtcttgatgcactatcatctca

SEQ ID NO: 240182 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacccgggcccgcctcaacgctagctacctccattgtctg

SEQ ID NO: 240183 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacccgggacccgcctcaagctagctacctccattgtctg

SEQ ID NO: 240184 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacagtgataactctcagaacgcgtctttcctccacgcat

SEQ ID NO: 240185 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacagcactggactctcagcgcgtgacccatctctcagta

SEQ ID NO: 240186 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aacagaggccctcgtgttggactaccaacttgtagaacgg

SEQ ID NO: 240187 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaatcggtacgcctacaatacgcctggtcactcttgttcg

SEQ ID NO: 240188 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaatcgggcccgcctcaagcctagctacctccattgtctg

SEQ ID NO: 240189 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaactggggcccgcctcaagctagctacctccatcgtctg

SEQ ID NO: 240190 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacggggccgccttcaagctagctacctccattggtctg

SEQ ID NO: 240191 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacggggcccgctcaagctagctgacctccattgtcctg

SEQ ID NO: 240192 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacggggcccgctcaagctagctgacctccattgccctg

SEQ ID NO: 240193 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacggggcccgctcaagctagctgacctccattatcctg

SEQ ID NO: 240194 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacggggcccgcctcaagctagctacctccattgtcctg

SEQ ID NO: 240195 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacggggccccgctacaagctagcttacgtccatgtctg

SEQ ID NO: 240196 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacggggccccgcctcaagctagctacctccattgtctg

SEQ ID NO: 240197 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacggggcccccgctcaagctagctactcccattgtctg

SEQ ID NO: 240198 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacggggcccccgctcaagctagctacctccattgtctg

SEQ ID NO: 240199 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacgggcccggcctcaagctagctacctccattgtcctg

SEQ ID NO: 240200 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacgggcccgcctcaagctagctgacctccattcgtctg

SEQ ID NO: 240201 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacgggcccccgctcaagctagctacctccattgtcctg

SEQ ID NO: 240202 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacgagggcctgcctcaagctagctacctccattgtctg

SEQ ID NO: 240203 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacgagatctcgtgacgcctcgggtccttccttcgactg

SEQ ID NO: 240204 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacgagatctcatgacgcctcgggtccttccttcggctg

SEQ ID NO: 240205 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggtggccgcctcaagctagctacctccattgtctg

SEQ ID NO: 240206 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggtccgcctcaagctagctacctccattgtctga

SEQ ID NO: 240207 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggggccgcctcaagctagctacctccattgtccg

SEQ ID NO: 240208 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggggccgcctcaagctagcaacctccattgtctg

SEQ ID NO: 240209 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggggcccgctcaagctagctacctccattgtctg

SEQ ID NO: 240210 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggggcccgcctcaagctagctacctccatgtttg

SEQ ID NO: 240211 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcttgcctcaagctagctacctccattgtctg

SEQ ID NO: 240212 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggctcgcctcgagctagctacctccattgtctg

SEQ ID NO: 240213 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcctgcctcaagctagctacctctattgtctg

SEQ ID NO: 240214 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccgcctcaagctagctacctgccattgtctg

SEQ ID NO: 240215 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgtctcaagctagctacctccattatctg

SEQ ID NO: 240216 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgctcaagctagctgacctccattgtctg

SEQ ID NO: 240217 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgctcaagctagctacctcctttgtcctg

SEQ ID NO: 240218 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgctcaagctagctacctccattgtcgtg

SEQ ID NO: 240219 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgctcaagctagctacctccattcgcctg

SEQ ID NO: 240220 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgctcaagctagctaccctccattgtctg

SEQ ID NO: 240221 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgccttcaagctagctacctccttgtctg

SEQ ID NO: 240222 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgccttagactagctacctccattgtctg

SEQ ID NO: 240223 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgccttaagctagctatctccattgtctg

SEQ ID NO: 240224 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgccttaagctagctacctccattgtcag

SEQ ID NO: 240225 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaggctagctacccccattgtctg

SEQ ID NO: 240226 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcacgctagctacctccattgtctg

SEQ ID NO: 240227 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagtctagctacctccattgctg

SEQ ID NO: 240228 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagcttgctacccccattgtctg

SEQ ID NO: 240229 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctggctacctctattgtctg

SEQ ID NO: 240230 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctcgctacctccattgtctg

SEQ ID NO: 240231 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctatctacctccattgtccg

SEQ ID NO: 240232 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctactttccattgctg

SEQ ID NO: 240233 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctaccttcattgtcta

SEQ ID NO: 240234 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctctattgtcgg

SEQ ID NO: 240235 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctctattgtccg

SEQ ID NO: 240236 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctcctttgcccg

SEQ ID NO: 240237 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccattgtgtg

SEQ ID NO: 240238 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccattgtcgt

SEQ ID NO: 240239 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagctacctccatagactg

SEQ ID NO: 240240 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagccacctcgattgtctg

SEQ ID NO: 240241 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagcaacctccattgtttg

SEQ ID NO: 240242 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagcaacctccattgtcta

SEQ ID NO: 240243 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagctagcaacctccactgtctg

SEQ ID NO: 240244 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagccagctatctccattgtctg

SEQ ID NO: 240245 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagccagctacctccatcgtctg

SEQ ID NO: 240246 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctcaagcaagctaccaccattgtctg

SEQ ID NO: 240247 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgcctacaagctagctacctccattgctg

SEQ ID NO: 240248 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgccccaagctagctacctccattgtccg

SEQ ID NO: 240249 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccgccccaagctagctacctccactgtctg

SEQ ID NO: 240250 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccccgcctcaagctagctcctccattgtctg

SEQ ID NO: 240251 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggcccacctgaagctagctacctccattgtctg

SEQ ID NO: 240252 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggggccagcctcaagctagctacctccattgtctg

SEQ ID NO: 240253 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggccgctcaacgtctggctacctccattgtcgtg

SEQ ID NO: 240254 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggccgcctcaagctagctgcctccattggtctgc

SEQ ID NO: 240255 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcttacaagctagctacctccattgtctg

SEQ ID NO: 240256 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgctctaagctagctaccttccattgtctg

SEQ ID NO: 240257 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgctcaagctagctaccttccattgtctga

SEQ ID NO: 240258 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgctcaagcctagctacctccattggtctg

SEQ ID NO: 240259 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgctcaacgctagctacctccatttgtctg

SEQ ID NO: 240260 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgctcaacgctagctacctccattgtctga

SEQ ID NO: 240261 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgctcaacgctagctacctccattgtcgtg

SEQ ID NO: 240262 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgctacaacgctagctacctccattgtctg

SEQ ID NO: 240263 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgccttcaagctggctacctccattgtctg

SEQ ID NO: 240264 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagtctagctacctcctttgtctg

SEQ ID NO: 240265 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagtctagctacctccgttgtctg

SEQ ID NO: 240266 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagtctagctacctccattgtcta

SEQ ID NO: 240267 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagtctagctacctcattgtcgtg

SEQ ID NO: 240268 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagtctagctacccccattgtctg

SEQ ID NO: 240269 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagtctagcaacctccattgtctg

SEQ ID NO: 240270 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagtctactacctccattgtcgtg

SEQ ID NO: 240271 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaaggctagctacctccattgtctg

SEQ ID NO: 240272 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctaggctacctccattgtctg

SEQ ID NO: 240273 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctagctcacctccattgtctg

SEQ ID NO: 240274 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctagctacctccattgttgtg

SEQ ID NO: 240275 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctagctacctccattgttctg

SEQ ID NO: 240276 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctagctacctccattgtccta

SEQ ID NO: 240277 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctagctacctccacttgtctg

SEQ ID NO: 240278 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagctagctaccccccattgtctg

SEQ ID NO: 240279 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagcctagctacctccatcgtctg

SEQ ID NO: 240280 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaagccagctacctccattagtctg

SEQ ID NO: 240281 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaacgctagctacctccattatctg

SEQ ID NO: 240282 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgcctcaaagctagctacctccattgtctg

SEQ ID NO: 240283 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggcccgccccaagctagctacctccattgtctgc

SEQ ID NO: 240284 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggagccgcctcaagctagctacctccattgtctg

SEQ ID NO: 240285 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggaccgcctcgagctagctacctccacttgtctg

SEQ ID NO: 240286 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcttcaagctagctacctccattgtctg

SEQ ID NO: 240287 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcctcaagctagctaccttcattgtctg

SEQ ID NO: 240288 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcctcaagctagctacctcctttgtctg

SEQ ID NO: 240289 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcctcaagctagctacctccattgcccg

SEQ ID NO: 240290 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcctcaagctagctacctccattatctg

SEQ ID NO: 240291 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcctcaagctaactacctccattgtctg

SEQ ID NO: 240292 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgcctcaaactagctacctccattgtctg

SEQ ID NO: 240293 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgggacccgccgcaagctagctacctccattgcctg

SEQ ID NO: 240294 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggaggccgcctcaagctagctacctccattgtctg

SEQ ID NO: 240295 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggagcccgcctcgagctagctacctccattgtctg

SEQ ID NO: 240296 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggagcccgcctcaagctagctatctccattgtctg

SEQ ID NO: 240297 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggagcccgcctcaagctagcgacctccattgtctg

SEQ ID NO: 240298 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccggaccgcctcaagtctagctacctccattgtcgtg

SEQ ID NO: 240299 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgaggccctcctcaagctagctacctccattgtctg

SEQ ID NO: 240300 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgaggcccgcctcaagctagctacctccatcgtctg

SEQ ID NO: 240301 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccgaggcccgcctcaagctaactacctccattgtctg

SEQ ID NO: 240302 - DNA, 40 bp, Artificial Sequence
  Synthetic oligonucleotide
  source (1)..(40): /organism="Artificial Sequence" /note=A"Description of Artificial Sequence: Synthetic oligonucleotideA" /mol_type="unassigned DNA"
aaaccgaggccccgcctcaagctagctacctccattgttg

SEQ ID NO: 240303 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacccggggccccgctcaagctagctacctcattgtctg

SEQ ID NO: 240304 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacccgggcccgccccaagctagctacctccattgtctg

SEQ ID NO: 240305 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccagggcccgcctcgagctagctacctccattgtctg

SEQ ID NO: 240306 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccagggcccgcctcaagctagctacctccattgcctg

SEQ ID NO: 240307 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaccagggcccgcctcaagctagcaacctccattgtctg

SEQ ID NO: 240308 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaaaccgaggcccgcctcaagctagctacctccatctctg

SEQ ID NO: 240309 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtctcttgtggtattgcgcatgcc

SEQ ID NO: 240310 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtcgtcctcttgtggtattgcgcatgcc

SEQ ID NO: 240311 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtccctcttgtggtattgcgcatg

SEQ ID NO: 240312 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtctctcgtggtattgcgcatgcc

SEQ ID NO: 240313 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
aaacggggccccgctcaagctagctacctcccattgtctg

SEQ ID NO: 240314 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgctccgtcctctgtggtattgcgcatgc

SEQ ID NO: 240315 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgtgtagtgctacctgctttaagctgcatcctgtaaatta

SEQ ID NO: 240316 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtcgtcctctcgtggtattgcgcatgcc

SEQ ID NO: 240317 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtcccgtcctctcgtggtattgcgcatg

SEQ ID NO: 240318 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcccgtttgtccgtcctcttgtggtattgcgcatg

SEQ ID NO: 240319 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactacccgtttgtccgtcctcctgtggtattgcgcatgc

SEQ ID NO: 240320 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
acactattccggtaaatcatcgtttaaccgtttgttgcaa

SEQ ID NO: 240321 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgcttgacgtga

SEQ ID NO: 240322 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagctacttcttcgtaacttgggcagttac

SEQ ID NO: 240323 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgatattaataaacgcgc

SEQ ID NO: 240324 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gagcttccttagtttttggcgctatccaattggcaactat

SEQ ID NO: 240325 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagtcattttcgctggaccacccgcgtta

SEQ ID NO: 240326 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatcgtttgtccgtcctcttgtggtattgcgcatgcc

SEQ ID NO: 240327 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cactatccgtttgtccgtcctcctgtggcattgcgcatgc

SEQ ID NO: 240328 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
attcagctggagcgctatctctggcaaatgggtccgtttc

SEQ ID NO: 240329 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgtggggcttttaagcacttctggtaacttgggcagttac

SEQ ID NO: 240330 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgtaacgctatttctgggaaccgctatctcgagctgaa

SEQ ID NO: 240331 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaacgctatttctgggaagccgctatctcgagctgaa

SEQ ID NO: 240332 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaacgctatttctcgggaagccgctatctcgagcgaa

SEQ ID NO: 240333 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgcgaaacgctattttctgggaagccgcgtctcgagcaaa

SEQ ID NO: 240334 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tgaagtctgcggtttcactagactactactgatcacgtcg

SEQ ID NO: 240335 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tcttccatctggtcgcgatacagaatacgattaacacaga

SEQ ID NO: 240336 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattggccagccacatcaactatgatgacgcttgactgga

SEQ ID NO: 240337 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatggcgcttggctgga

SEQ ID NO: 240338 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattcgccagtcacatcaactatgatgacgtttggctgga

SEQ ID NO: 240339 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tattccccagccacatcaactatgatgacgcttgactgga

SEQ ID NO: 240340 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaacttgggcagcta

SEQ ID NO: 240341 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatggggcttttaagcacttctcggtaacttgagcagtta

SEQ ID NO: 240342 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagctacttctcggtaacttggcagttac

SEQ ID NO: 240343 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttttaagcacttctcggttaacttgggcagtta

SEQ ID NO: 240344 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttagcgcacttctcggtaacttgggcagttac

SEQ ID NO: 240345 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggctttaagcacttctcggtacacttgggcagttac

SEQ ID NO: 240346 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tatgggcttctacgcacttctcggtaacttgggcagttac

SEQ ID NO: 240347 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
tactacccccatcgagcgagtctactctcccatcaacgga

SEQ ID NO: 240348 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccgtcttccctaatgtacattacgaatagacatgcgtg

SEQ ID NO: 240349 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtccatggtacgactcgattccgcccatacatgcatgtaa

SEQ ID NO: 240350 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gtcatgggctttaagctacttctcgtacttggcgagttac

SEQ ID NO: 240351 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gcggtttcttctcctgactacatgagatcaataaactcgc

SEQ ID NO: 240352 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcggttttggtggggactaccccccttgta

SEQ ID NO: 240353 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
gccgcatgggtcagttttggtgggggactacccccttgta

SEQ ID NO: 240354 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccggcacgacgtctttcgtgcactatcacgatt

SEQ ID NO: 240355 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ctcttatccgcaggcaggacttcgttgcactatcacgatt

SEQ ID NO: 240356 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgttggaagactacttccattttagctgccagctgttctc

SEQ ID NO: 240357 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
cgctatccgtttgtccgtcctctcgtggtattgcgcacgc

SEQ ID NO: 240358 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccttccagggccaatgtccgcattatcatcctatgttctg

SEQ ID NO: 240359 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcatccccgatagtcatcttcactggacacccgtgtta

SEQ ID NO: 240360 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcacccgatagtcatcttcactggaccaccccgtgtta

SEQ ID NO: 240361 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgattgtcatcttcgctggaccacccgcgtta

SEQ ID NO: 240362 - DNA, 40 bp, Artificial Sequence
  Synthetic oligonucleotide
  source (1)..(40): /organism="Artificial Sequence" /note="Description of Artificial Sequence: Synthetic oligonucleotide" /mol_type="unassigned DNA"
ccgcaccccgatagttgtcttcgctggaccacccgcgtta
